United States Patent 12,642,819 (COMPOSITIONS AND METHODS FOR TREATING INFLAMMATORY BOWEL DISEASE) - sequence listing, part 23

SEQ ID NO: 9 - DNA, 7032212 bp, Bacteroides ovatus (residues 1-1,758,053 of 7,032,212)
  modified_base (543562)..(543660): a, c, t, g, unknown or other
  modified_base (1090440)..(1090538): a, c, t, g, unknown or other
  modified_base (1359372)..(1359469): a, c, t, g, unknown or other
  modified_base (1363379)..(1363476): a, c, t, g, unknown or other
  modified_base (2710937)..(2711034): a, c, t, g, unknown or other
  modified_base (3842165)..(3842261): a, c, t, g, unknown or other
  modified_base (5559897)..(5559995): a, c, t, g, unknown or other
  modified_base (5768505)..(5768603): a, c, t, g, unknown or other
  modified_base (6991046)..(6991227): a, c, t, g, unknown or other
  modified_base (6997231)..(6997326): a, c, t, g, unknown or other
  modified_base (7004550)..(7004669): a, c, t, g, unknown or other
caaacctgtaaccggctgatccgtagtcagctactctattcagttgagctacgcggccattctgttaattcaaaaaagtgatcgcgacaggattcaaacctgtaaccggctgatccgtagtcagctactctattcagttgagctacgcgaccgttattttgttttaacgggtgcaaagatacggacttttcccgaattagcaagcttttcaccgactttttttgtagaaaattattctatgaaccgataattgaatagttgtaaacctatacttagtccgacattccactcccttttcggtgagctataatgatttacatatgcagagatatctccaaaaggcaattgacatacaacagaaatttctcctaaatattcaaacttggagaaagcttttccgtaatatgctttattcaacgagtttttttcgattggataaataggcataaaaccataaaattctccccgaagatggaacatctggcttaaacggtaaataggccgaatgccggctccgacaaattgattggcacgaaaggcttcgttgtaagtcaatttgctatgtaatgtaggagaaaactctccagcttgcatcattgtggccgtatagttctcggagaagtttttggaggcatacagggctttcaaataccatcctaaaacccaatgttcactcatattatgatatttctctttcatataagataattgcagccaggagtgatgatctttgttgttactggtcgtacttccttcgcccggatagaatcgttcttttccaacgaaaatctgggctacaagggcttctctgtatccacgtgtaggatattgtttggaattaagagtacttccattaaaactaattgatccaccaaataaatcatagcggcttttatcaaatttgtcatttccgaagtcaatgacacttttttgaaaatatttatcctctattcttgcaattcctactccaaactctgctcgcttgctcgaaaggaaaggtaatccaacctgtaatttcaagaaacgttcgtctttctggttaaaggccggtttgttatttcgcgaaaaaagtttgtccttcttaaaatagtcgaaagtactgatcgaacctataagacgatacgaggtaggaatggcagtggcaaagtctatttttgccataaattgcacgttgttatatacctttccaagttgcccgtcaagaataaactctttggcatagtagtttaagtcctgataactaagtcccaggtagatctgattcgaattggaggtggatatgttacctcccagccgtacagcaaagttgttttccagtttgacttttaaatgcagatcataggtgtcatcttccggattataaattgcatgcggtatgatttctgaaatcattttatctgatagcaatcgaaaataaccttgctttaaatcttcataggtgaattctttgttatccgacttatgaaattctttcttcatatatgcctgttgttgtggattagctccatcaatgatgatatttttaaaacgtagttccgggaaattactacggtataccattctccttaaacgaatattgtccagattcacacgccgatggatacggcttttgatagaatccatcatgctgatggttcgattatatcctatatcatgtaattcgtcgatgcgttgaaaatccatcagattgacgttgtcatatttgaacgtcattaaaatccccatagagtccggaatagaatagtcggttttctgcatcaccatattctcaatttgactcatgaggtcattttccttgggtttagtgggattggtggatacaacgcttcctataatgacatccggatgaaaatcatctctcatgacgtccgtgggaaagttattatagatacctccatcgtaggccagtacattgtctatttcaatgggtttaaacatgaaagggaagctcatggaagctctgacggcatctcctaaatctccttccttcatgactaactgttttttattgtacacatcggacgcaatgcaacggaaaggaacaaaaagtttatcaaaatctcccttacaagcggccgtagcacgtgcatataggtcaacaaacacgagattcatttgaatcgggttgacaacactggtaggcaggaattgaggttttaaactcttcagtgaatctttgaatgaaaaacgaatattgaaaaattcgggagtgggaagattctttttgaaatgatatacgtatttctcttccacttctccggaataccatcgtttaaagtcctccgatttgagcagttctaccatgtcgtcaggagagtatcccatggcatacaaggagccgataatggctcccatggaagtaccagcaatgtagtcaatagggatgttgttttcttccaatgcgcgaatgatgccgatgtgcgtcattcctttggcgccaccaccgcttaatacaagtcctactttttgggcatggatagccgggataatcagccataaagtaatgaacactaaaaaaatctttctcataacccaaatcaaacaattgaattttttgtctattaagtgttcaaatatatacaatacttttcaattaatcgatattttgccgatcgttttaaattgaaaaagagcattacaacgtgtatttaacgttgaatgctctttcttgaagtatgtgtaatgtttaaaggggcgatattaaatcagctcaatgctacgttttacgaagttattcaaagcttcacctcttaacatattgttttgaagtaaggccagatcgataagctggcggataactttgttattgcttgcatagccgataaagatagcttctttcttgcttttcagatcatcccacttcttgtcgagatcgtttaattcatctttttcagctgttgggatgtcttcttcctttttatccttctgtttgtctttcaactcattacgttgtttgttgacgttatccatttcggagagtatcggagctacttctgcttgacaggcattctcttcttcattcaatacttgttttatcaacttgtggtctgaattcaggatcagattgaacatgtcaggcatttcgccgtagaagctcattccggcttgaatatttgccatttctttcatacgacgcatatattcgctttgagtaatcatgaccggagccgaattttctcccaacgcttgcgtcatcacattgaattcaaccttatccattttaggcaattggctcttgaaggctgttgtgattgcatcttgtttgctggcttccagagtttcacctttcttgtcttcttttacaatcagattgtcaacaacatcactgtctacacgggtgaaacgggatttctcaagcttttgctccaacatacttaccatagctacatctaactggccatccatgagcaagacattatagcctttattggttgcagcctcaatatagctgtattgttcgtccttgttatttgcatacagatagattagatttccatctttgtctgtctggttatctttaataagggtctgatattcctcgaatgtgtaatgtttgtcatttatatcggtgaaaagggcgaatttttgcgctttatcatagaaatcctcttgtgtgagcattccataattgataaatattttcaagtcgttccacttttcttcaaactgcttacgatcattcttgaatatagactgtaaacggtcggaaactttcttggtgatataagttgaaatcttcttcacgtttgagtcgctttgcaagtatgaacgggaaacgttcaacggaatatccggagaatctattactccatgtaacaaagtcaggaagtccggcacaatgccttcaacagagtctgttacatatacttgattgcaatataactgaatcttgttcttatttaattcaatattgctctttaccttcgggaagtagaggataccagtcagatggaatggataatccacattcaggtgaatccagaagagtggttcatcagacatcggatatagcttgctatagaatgatttgtaatcttcatccgaaagttcgctaggtttgcgtgtccacaaaggagtggtgtcattgattatattatcttcagccgtttctacctgtttgccgtctttccattctttcttttttccaaatgcaataggaacaggaaggaagctgcaatatttcttcagaagttcggagatacgtgcttcttcgaggaattctttgcagtcgtcatcaatgtataagatgatatctgatccacggtcggctttttctatttcttcaatagtgaattcagggctgccatcacaagtccattttacggcttttgcatcgtctctgtatgatttagtgataatctccactttctttgcaaccataaaggcagagtagaagccaagtccgaaatgtccgataatggcatttgcatcgttcttatacttctccaggaagtcattagctccagagaaagctatttgattgatgtacttctctatttcttctgcagtcaaaccgataccacggtcagaaatggtaatagtatctttgcctaattcaacgtgaacagttaagtcacccagttcacctttgaattcgccaatagaagcaagcgtattcagcttctgagtggcatctaccgcattggatactaactcgcgcagaaaaatctcatggtcactgtacaaaaactttttaatgatagggaaaatgttttctgttgtaaccccaatattacctttttgcataatacgtatatttttttagtttatctattgattaattttaattgatatttgtccatacagagacaaaaaaaatgccagacccgaaggtctgacattatggcatattaaattattttcttattcaggaaataactctattccggagaaacaactttcatctccaattcgcctttttcttcattaagggttacttgaatagtatctccctcttttaaagacgaggaaatgatgagctcggataaaccatcctccagataggtttgaattgcgcgcttcaaaggacgggcgccatattgtatgtcatatcccttgctagcgatgaattctttcgccttatcttcaataacaagcttgtaaccaatagattctattctatcgtacaatccttttagctctatgtctataatctttgttatcgcttccagagaaagttgatcaaacgtgataatctcatctacacgattgatgaattcaggcgcgaatgatttatttagagctttttgtataacacttcgcgagaattctttatcatccaggcggctttgtgtcgcaaaaccaacaccacgtccaaattctttcagctggcgggttccgatattggaagtcatgataataacggtatttttgaaatctaccattctgccataactgtcagtcagacgaccctcatccattacctgaagcaggatattgaatacatccggatgtgctttttctatttcatcaagcaatacaatagagtatggtttacggcgcactttttctgtcagctggccaccttcttcatatcctacgtatcccggaggtgccccaaccaagcgtgaaacagtgaacttttccatatattcactcatatcgatacgaatcagtgcatcggcagaaccgaacatatacttggccaactcttttgctaggtgagttttaccaactcctgtcggacctaagaacataaacgtgccaatgggcttattaggatctttgagtcctacacggcttcgcaaaatggctttgaccagcttttctatcgctgtgtcttgtgcgatgactttagcttgcaaatcttctttcatacctgctagcttgatgccttcggcctgtgccattcgttgtactggaatgcctgacatcattgagataacattggcaatttcttctgcatcaacagtttgcctgttttcttttagattggcttcccattcttttttcatctcatccaattggatagaaagttctttctccttatcacggaagctggctgcaagttcaaaattctgcgattttacggcttcatttttcttgtttttagcttcttcgatcagcttttcctgttcttctatctctttgggtacattgacattagtaagatgtacacgtgagccggcttcatctaaagcatcaatggctttatcagggaaattacgatctgtgatatagcggtctgtcagcttgacacatgcttccaatgcttcatctgtataatacacattgtgatgatcttcatacttatccttgatattacgcaaaatctgcagagtttcggcagcagtagtcggttctacgattactttttggaaacgacgttccaatgcgccatctttctcaatattcttacgatattcatcaagagtggtggcaccgatacattgtatttctcctcttgccaatgctggctttagcatattggcggcatccatagagcctgctgcagagcctgcgcctacaatcgtgtgaatttcatcaatgaataatataacattcggattcttctgcaattcattgagaatggaacggatacgttcttcaaattgtccacggtactttgttcctgccacaacagcagtcatgtcaagagcaacgactcgtttatcaaacaggatacgcgaaacctttttctgaatgattctcaatgcaagaccttcaacaatcgctgattttcctacaccgggttcaccaatcagaattgggttattctttttgcgtcgacttaatatctgcgctaaacgttcgatttctctttctctgcccacaacaggatccaaccgtccttcttctgccgcttttgtcatgtcagtaccgaaattgtcaagtaccggcgtatcattagacggcttcttggaagcggtttgtgcctgttggcgttcatccgaaccacctctgccggaacgaggagaagacatttcttcgtcatcctcatcgtcttccgaaaagcccatgccggaattgacatccggctgcaatgtagcttgctccagtactttcacgtagtttatatcgtttgcttcaagtacggaagccgccatattgtttttttctcttaaaatagccaataatacatgttctgtatcagcgatgttacttttcattccacgagcttctaaaatacacatttttaatatctttgccgcatcattagataacggcacctctgcatcaggcaataacatttcatcagcttctgccttcagctgagcttcaatctgttgctttatagcagccagattggtgttgagtttagacaatatctcgatagcttttccttcaccgtcacggagtattcccagaagcaggtgttcgggacctatatacctacttctcaaccggttcgcttcttccttactatagacgataatgtcggaaactctttgtgagaattgattattcatacttttttccttttcttctaagggttattcactggcaaatatacgcatttaatcaagtttgtattgcaatatttgctttatttcttatatctacaaatggcgtgccataaaaacagtgtatttgtattatatatataaggtataacaaataataggctcttttttaccgatgttatttatctttccatattatatttatcgtttttatctttttatttttgtattttaaagtttggcgggttatcgtctcggtcatgataaaactttctttctaaaaactttcgtatatcggggaaaagtagtactttagcgtggtttttcacaaaccgtagaatgtataattaataatcattttaaatgcttgaacaagacagaattataaagattaacatcgaggaggaaatgaagtcatcgtacattgactactccatgtcggtcatcgtttcgcgtgcccttccggatgttagagatggatttaagcctgttcaccgtagaattttatacggaatgatggaattaggcaatacttcagacaaaccttataaaaagtcagcgagaatcgtgggtgaggtacttggtaagtatcatcctcatggggattcttctgtttattttgcaatggtacgtatggcgcaggaatgggcaatgcgttatcctttggtagatggacagggaaactttggttctgtggatggtgatagccctgctgctatgcgttatacagaagctcgtctcaataagttgggtgaagcaatgatggatgacctgtataaggaaaccgttgattttgagccaaactttgataatacgctggtggaacctaaggtgatgccgacgcgtatcccgaaccttctggtgaacggagcatccggtattgctgttggtatggctaccaatatgcctcctcataatctttcggaagtgattgaagcatgtgatgcatatattgataatccggaaattacggtagaggaactgatggaatttgttaaagcaccggatttccctactggcggatatatatatggtgtgagtggtgtacgcgaagcatatttgacaggtcgcggacgtgtaattatgcgtgcgaaagctgaaattgaaagcggacaaacacatgacaagatcgtaataacagagattccttataatgtaaataaggccgaactgattaaatatattgctgatcttgtaaatgataagaagatagaaggtatctcaaatgccaacgatgagtctgaccgtgatggtatgcgtattgttattgacataaaacgtgatgcaaatgcaagtgtagtgttgaataaactctataaaatgacagctttgcagacctcttttggtgttaacaatgtggctttggttcatggacgtccaaaaacgttgaatctaagagatttaattaaatatttcatagagcatagacacgaagttgttattcgtcgtactcagttcgatcttcgtaaggcgaaagagcgtgcgcacattcttgaaggtttgattattgcttcagataatattgatgaagtaattcgtatcattcgtgctgcaaaaactccgaatgacgcaataacaggcttgattgagcgatttaacctgacagaaattcaggctcgtgcaattgtagaaatgcgtttgcgtcagttaaccggtctgatgcaggatcagcttcatgcggaatacgaagaaataatgaagcagatagcttatttggaaagtattctggctgatgatgaagtatgtcgtcgggtaatgaaagaggaattgttagaagtcaaagcgaaatatggagatgtacgtcgctctgaaattgtttattcttcagaagaatttaatccggaagacttctatgcagatgatcagatgattattacaatttctcatatgggttatattaaacgtacaccgttgaccgaattccgtgcacaaaatcgtggtggagtaggttcgaaaggtacggaaacccgtgatgaagactttgtagagcatatttatcctgctaccatgcacaataccatgatgttctttacacaaaagggtaagtgttattggctgaaagtatatgaaatacctgaaggaacgaagaattctaagggccgtgctattcagaacttgttgaatattgattcggatgataatgtaactgcatacttgcgtgtgaagagtttagaggattccgagtttatcaatagccactatgtattattctgtactaagaaaggtgtaataaagaagacattgcttgaacagtattctcgtcctcgtcagaatggtgtaaatgctataactatccgcgaagatgatagcgtaattgaagttcgtatgacgaatggaaataatgaaatcatcattgcaaaccgcaatggtcgtgcaattcgtttccatgaggcagcagttcgtgtaatgggacgtacagcaacaggtgtacgtggtattacgttggataatgatggtcaggatgaagtagtaggaatgatttgtatcaaagatttggaaacagaatctgtaatggtagtttccgaacaaggatatggtaaacgttctgaaattgaagactatcgtaaaacgaaccgtggaggtaagggtgtgaagaccatgaatattaccgaaaagacaggtaagttggtaacaatcaagtcggtaaccgatgaaaatgacttgatgattatcaataagtctggtatcactattcgtttgaaggtagcggatgttcgtataatgggccgtgctactcaaggcgttcgtctgataaatcttgaaaaacgtaacgaccagattggttcggtatgtaaggttatgacagaaagtcttgaagatgaaattccggcagaagaggcagagggtacaatcgtgagtgatccgaatgctgatgttcctgatattgatgatgcagcggacgtaaatgaaaacgaaagcaataacgaaattgaggaatagacataatattaataattaatcaaacaacaatcatgaaaagagtattattttctatggttttattgatggctgttagcttctcattcgctcagatgaagaatgtgaaagaagcaaagagtatggctaatgacgtaaaacctaattttaagcaggctgaacagcttattaaggaggctatgaagaatcctgaaacgaaggatcttgctgacacatgggacgttgctggatttattcagagacgtatcaacgaggagcaaatgaaaaatgcttttttgaagaaaccgtatgatacattgaaagtatacaatagtattctgaaaatgtatgagtactataataagtgtgatgaattagcggaaatacctaatgaaaagggaaaagttaaaaacaaatatcggaaggctaatgcttccagtatgttggctgaacgtcctaatttgattaatggtggtattcagtatttcaacctggacaagaataaagaggctttgaagttctttgcaacctatgtagagtcagcttcttatccgatgttagctgataaagaattggctaaaaacgatactcttcttccgcaaattgcttattatgcaacattagctgctgatagagtaggcgataaagatgcgatcattaaatatgctcctatggctttatccgataaagatggaggtaaatttgcaatgcaattgatggctgatgcttataaagctaaaggtgatactgctgcatggattaagtctttggaagagggtatccttaagttccctggaaatgattatttcttcgctaatttggttgattattataatagctctaatcaagcttctaaagctatggagtttgctgatagaatgttagctaatgatccgaataacaagttgtatttgtatgtaaaagcatatctttatcataatatgaaagaatatgataatgcaatcgaatactacaaaaaagctattgctgctgatccggaatatgcagaagcatactctaatgtaggtttggtatatttgatgaaagcacaggattatgctgataaagcaacaacagatatcaatgatcctaagtacgctgaagcacaagctgtggttaagaaattctacgaagaagctaaaccattctatgaaaaagccagagctttaaaacccgatcaacaagatttatggttgcaaggtctttacagagtttactataacttgaatatgggacctgaattcgaagaaatcgataagatgatgaagtaagatcgttttctgaaaaaatataagaaggctattagaaatagtagtcttcttttttttattcaatagtttaaagtagtaattgaaaaatcttatatttgatatggacttgagtggaacaggtaaatttcttcatttaaataaaaatagaaaaaggagtaaggtcattatattactcctttttctattaaacataatacttattattccctaatcttggatgctcattttttgcctgatttgatcagctgttaataacaagcaatggtgtatctgaatggaaaatcatttttctggcaatacttggattaaataatcgagcaaatatattccttttgtaagaagtcaaagtgattatatctatatgattatctttgatatactgatcaagtccttttaataaattatcattcatcactacgtcataatgaatttcaagccccggatattgcttgtgaaaatattcttttatacctgctagttttatttcattccaggtatctttagaatctgtaaggtgtatcaaagatacagaaaaatggaatgatttccaagtattaaagaatgcctcgaaagcaattagatctctttgatcaaaattggtaataaaggcaatccgttttgcttcactaaactgtttaaatggtgtattttccggaatagccaatacagccgtgcgactcctgtcaataacttcagcggttacactgccaattaaatcaatgtctttctgatttttgcctcgggtacccataatgatgaccataggacgctgttctttagcatatcttaagatttcctcctctggaataccttcacgtaagatgcagctatatttaacgttgggaaattcgcctgatgtaactttttcttttatcttctctgataaagcattgagatcagaatggactttttggataatcgtttttacagattcttcatctccaatctggtaattgaaaacatccccataaggcaacgacgatgcataaataggcgtgaaatagacatgcaacaggatgacttctgcattttctgtttttgccaggttgaatgcaaattcacatgctttcatcgaataattagagaagtcgacgggaattaaaatcttatttgatttatcttttactttgggctccttctctcccactatactttcagacagccatgtagaactttctgttattttcaaagcacgtggcagatcgctttctttaattcgtaaacgcactcctgatgaaacaaccggttgtatttgattaacgttatgaatgtaggtttctataccttcattttccaagacattctttaagatctgcgctttggtgtatgtcagaatggccagggttactaatttgtcttccataaatgtacattttataaggtgaaaacaaataagaaatcccaattgtttgattcaattgggattcagtttgttatattttaaacttgcacagattcggtagcctgttctttttgcatactcatattcaattcatctaggatttttaaagcccgatcaagaacggtcgtgtcatccaacattacaagcccaccatctggaccgggctcgagatgtattccgacgctttttccctccttgaaattgtgtcctccgaagaagtttcgcactgtatctacgtgcaaaccaagttcgtctgctattctatgcatgctaccgctaggcaatgaatctttaattttacgaagttcattaaacgttattgttctcatgtctcataaatttaatggttaatactatgtgatttttttatcacgctataaacttaagcaaaaaaaaagataaaacaaattatttgcttatctttttttcttgaatatataaaatctattaatgacctttatatcacctcgatagcagaagcaggtacccacccgacttttccatcttccagtcgaatttctttccattctttcatagagttgtctttgacacttacctttctcccttcatggagaataaacaagctagtcccactctcacttggagtacttcgtactgttacactcggattcattactatcgcctcacttcgattaaccaaatgctctttttgttgcgaagcaaaaagattagagcaaacagtgacaatcagcaaaatgattcctgatatgaatcctattttctttaacataatctgtttggagaatataaagaaatagaaagcgataatcaatagaataaaggagacaataccccatgtggcccatgcatctacactcatactatttgtcagagatttgatccatgaaacaaagaatacttcaggaacaggttcaaccttgtctattgtttttgcacgtgccacttcaagattagcacggatgtcaccatttcctggttgtaatagcagagcacgctcataatttaaaacagctttcgctatctcccctattttataataactatttcccagattgtaatagacgtcggcagcttctccatttttcagtaatgcttcatatatctgaatagctgctgcataatcttcttttatatatgcggaatctccttcagcttttgttgcatcttccagtgtattactggaaaatgtggtatgcgaagcgtggatagaatcaactccattcgtttgtctagtatcaatgcttaacgaatcttgtccgaaacaagtaagcgacattgataataatataaaaaataatatctttttcatgacataatctcttctgggttaatgttttattgaattctccattttgcttattacttctattgaagaagaataaactttatccatagcttgattctcatcacctggagcaaaccgtgcaaattcacaatcattcaatgcattcaggaattctttgattagttcctcatttactccgtgatttcttagtttctcttcaatattatctttagataaacgagataccggaatattcagtttgtcacttatatatccccacaatgcctttaatacctcatcgtagaaagcatcttttttattttcggagagtaattttcctgcaagcttcatacgcttcgttgccactttatttgctttcttcgtacgcattttagcaacatttgcattttcagcagcttgcttacgataaataataaagaaaataataaaggcaagagccggaatgatatagaataaccaatatgtcattgaaccatagaagaaacttcctttaggttggagagtaacttcattctgtttgatataacggatgtcttcacctaatactttcaagtcctctttattcgtgaagttagcaattacttgatccgcattacctgcacctttctcaacatttactacataatcttctgttttcagtgttttgtaagacttggagcgaatatcaaaatagctgaaagatactcccggaatcttatatgttccggcatgtctcggaattgccaaatattcaataactttattgcctgtgagtccttcccgggttaatctgacttgattgtctactttgggatcatatacttcaaaatcatccgggaatttaatttccggattagaaatcaatttcaggttacctgtaccggatattaccagtttaatagtaatagcatcattggttttcagttccttactgttgatagaagaagatatattgaactctcccactccacctgaaaaatctgcaggtttacccgtaggaagcggattgacatttattgctatcttaggagtggaaatattttttttaatttcaatgacattacttcctccattgaagaaggcatcaaaaggatcatctgattgcacaggttttccgatagtcatctggaactgtgccggatcaatatatagctttcctgattgttgcgggaagagaacaaactggcgataaaccgttgtatagtaattacgtccctgataatgttcgggagtccatcttgcattggttgtcatttctatttcttgagaatggaaacctttaaagtcgggcaatttcgcattattaagttgtaagttggattctctggtgtatattttataggtcaggacaaaagcctcctgttcatacacatttgttttactggcacttgccataataaaaaggtcctgattagagacacttgtaccagatgaggaatgtatagaaccactactactattattttgtccgctattgccaccttgatcttgtggcaatactttaatctttactgagtttgacaccatttggtcaccatcggcaataatggaggcaccgggtattgtgtattctccggcattattagccattaatatgtatgtaaatgtaatactgctagtagatgtaacattaccattcactatttgagtactactttgttgtgaacggcttggacccatcaatacatcaaaacctttgattgatggtgcccgaaaatctttcactttttgtgtagttacaatatacgacagcctgaattgttcgcctactaccactgcatcaggagcagaagcagtaaaagacaccttatcagcaaacacatgagtgctatatgctatcaatgccatcaatataataatcagttttttcattgcttatgaaatttatatcatcaactttatattaccaatctttttccaagcgaccgccttgcataactttttgttgcttcttcactttatcctgcacatctttttcgtcctgcatgacagagttcagtaattgttcagcattctcctttgacatctgattgtcttgtttcttttcagatttcggtggttgctgctgatctttcttttcatcttgtttctgatccttctgtttgtctttattctggtcctgtttctgatcttgcttttgctgatctttgttttggtcctgattttgatcttgattctgctgattttgttggtctttcagcattttctgtgcgagagccaaattgtaccgggtttcatgatcggtaggattattacgcagtgacattttatatgcatctacagctttggcatagtctttaccagcctggaaaattactcccatattgtgataaatatgggcgagtttcattttatctttttctattttgctggccgatacatattgttccatggcatcctgaaacttttgctgttgcgaaagggtatttcccagattatacatggataccgtagacttgggattagcttccaaggccttccgatagttcacctctgcatcaacaaatacgctatcattaaacagacggtttcccttacggatatagtcgcgttctgctttctgagccgatacaccagctgccgctaacagaaatacagcgaatagaatatatttactttttaacatacgtataactatttcttattagaaaacaggtgaatgttcttaaataaaggatttttgcgatccagaattaagatttctgccaataacaatagtagaataacccatgcaatagcctggaattgttcgttaaactccgtatatactttcgactctacatcagatttcgccattttattcacttcttgattgatggccttttgggctgaattagaattatctactcgtacatatataccttttccttcttttgcaatttcctgacacatagcttcattcaaacgggtaacaatcacattaccttcccggtcgcggcggtaatcattcgttccttccaccggtattggagcgccatcaggcatacctactcccaatacacttacctgaatacccttttctgccgcagctttggcagcttccactgcaccaccttcatgattttcaccatcagtaataacaataatggcgcgtcctaccccttcttgcggagtgaaactacgagctgccagattgattgcttccccaatagctgtaccctgtttagaaatcaacgaaggactaatggattctaagaacatcttagcggaaatatagtcacttgtaattggcagctgtgtaaaagcgtcaccggcaaatacaatcatacctaccttatcattatcaagctcatctactaatctggatattaatctttttgctttttctaaacggctaggctgtacatcctgcgctaacatagagtttgaaatgtccaaagcaataattacctctactcccttgcgtttaaccgtttccagttttgaaccgaattgagggcgtgccagtaatacggagaacaaaccaatagcaacaaaaataatccagaattttacatccggacgatatttggatacgtcaggcattaactgagccaacaaagtcggatctccgaaacgtcggatattctttctcctcttgtaattggaatacaagtagaaagctgctaaaaaaggtaatagcaacaataaatataaatatgtaggttctccaaatcgaaacatcttcttactattttatgattggcaaataacgattgacaaacatccttatggaattttcttgagtaccgaattacgtaatagtacttccaacaagacacagaggaaagctgctaaagcaaaccaatgatattcttcgtcccgcttactatactcttttacattcagtttcgtcttttccagtttatcaatttcttcatatacttctttaagcttcgagttgctcgtagcccggaaatagttaccatctgtcgttccggcaatctctgtcaatgtcttttcatcaatttctaccggcatacttacatattgcaccgtatttccgactggataaggataaggagccattccattggtacctactccgatggtatatacacgaataccaaagctttttgctatttctgccgctgtcataggcgaaatatctcccttgttatttgtaccatccgtcaataggataataactttggatttcgctttgctatcttttaagcgggttacagcatttgcaatacccataccgacagcagtaccgtcagtgataagaccacatttgatattatgtatcatatccaataatacagcatggtctacagtcaacggacattgggtgaaagtttctcctgcaaataatgtaataccgatattatcattgggacgtccattgataaactctgcagctacgtctttagcagcttccagtctgttcggcttcaagtcttcagccagcatactggtagaaacgtcgatagccagcataatatcaattccttctatctcactgttctgccacttattagtagtttgcgggcgtgcaagaaccaaaataaccagtactaaagcaaggcagcgtaatagaaatggaacatgcaacaaataattcttataacttttaggtgtatgcgcatatacccgggcatctgaaatttgaagagttgcttcacttttcttttgcttcaggatataccatacaatatacggtataagcaataatagcaaaaacagatattcaatattggcaaaaaccattttatttatgatttaacagtttactatttagtattaagctatacatcctttatacaaaaagattgtataactgtagacctatatatataaaggtaccgatcaatgctgctgataacaatgcaattccacaaatcagcatagctttaacacgtaaagaacgtttctcaataatagtgatttccgttggttgcggtttctgattttcctcttccagttgtttggtctcattgataaaatcaatggcgttaatcaaattggcatcgttttcattcatctgaggattatgcttggcgaacttcactaaatcagcagtctggaacaatagttttaggtctgatatggcctctttatcattcatttccagtaactgatcaattatttcagaagaagtcatttccaatgcattaaatccgaaacgatccttaatatatgtacgaatagcatcggtaagttcggtatagtactccttcgattgccctttctgccacaccttctctgtcttgatacgttctatctctttcattgcagcctgatgtggcggcaatttaggttcaactttaattttacggataatcggtttattatcacgtatgcgaacaatcagatagatcagcaaaccaagcaaaggtaaagccaagaatgaacaagcgatcaatccataccagtcttcccatgcaaaaggagctttcatcacagatttttgtccgaagaactggtccggatgtaaggtgtcaaccggcattgaatatacttttaatgcgagagctttggagttgtacactttcccatctacggtaactggcattggcgggagataatatagagcagagtcaaaagaagtgataatgtactcctgcgtaatcaccatccgctgacgatcattcaggaattgggtatctggtttgactgtttctataatttccacacctcttaccagtgtatcagtgtaagcaggaaaaatagcacgctgtttggcatccatggctacttgcagttgcactttcgcctgttcgccgatcagtatctgcagtgaatcaatttttgcttctactgtaacagactgtgctactgctttactgacaaacaatagacctaataatgctatcagaataatatttctattcatctttgattccattaatttcgtttggcaaataaattcaacaatgcctttacgtaatcctgatcggttctgacggatacagcatctacgttacttttggtaaaagtatcgttcagttcagtctgcttttgtatccaccagtcgcgatgtgcccggcgtacagctttggaagaagtgtcaatccattgttcatgcccagtttctgcatctttgattcgcatcagtcctactggaggaagatcactgactctcctgtcgtatacttgcaatgctactacatcatgtttcctgttagcaatggtcagcgcattcttaaagctttcctggtcaataaaatctgataagataaatgcagtgcaacgccttttcattacgtttgtcaaatattccaaggcaagacgaatatttgtgcgacggctttccggttggaaatcaattaattcacggataatatacaagatatgtttacgtcctttcttgggaggaataaacttctctatccggtctgaaaagaaaatcacacctattttatcattattctggatggcagagaaagcaagagtagcagcgatttccgtcaccatatctttctttaactgcttgatcgtaccaaattccaaacttccggaaacatcaaccattaacataactgtcagttcacgttcttcttcaaacactttcacataaggtttattgaagcgcgcagtcacattccagtctatgtcacgtatatcatcaccgaattgatattcacggacttccgaaaatgacatacccctacctttgaaagccgaatgatactggcctgcaaagatattgttagacaatcctcgtgtctttatttcaatttggcgaactttttttagtatttcacttgtttccatttatacagtagttaattagtaggtagttaagtagtcatgcatagatatttatgactacttattgactgtattataactacaaattagggtacttcaaccttattcagaatcttactgatgatttcgtccgaagtcatgttgttagcttcagcttcgtatgtcaatccgatacggtgacgaagaacatcatgtgctacagcacgtacatcttccggaataacgtagccgcgacgtttgatgaatgcatacgtacgagcagctaaagccagattgatagacgcacgaggtgaacctccgaatccgatcatatctttcagttccttgaggtcatatttttctgggaaacgagttgcaaatacgatatctacaatataacgctcgatcttctcatccagatagacttgacgaacaaccttacgtgcttcaataatttcatccgctcttagaataggtttcacattgaacttctcaccattgatattctgacgaataatcaatttttcttcttccaacttcggataatcaatgactactttcagcatgaaacggtcaacctgtgcttcaggaagcggataagtaccttcctgttcgatagggttctgagttgccaatacaaggaaaggttccggtaacatgaatgtttctttaccaatagtaacctgacgttcttgcattgcttccagcaaagcactttgtacttttgcaggagcacggttaatttcatcagctaatacaaagtttgcgaaaataggtccgcgctgcactttaaaagattcatctttctgactgtaaaccattgtaccgataacgtctgcaggcaataagtccggcgtaaactggatacggctatatttcgcatcaatcagagaagcgagtgtcttaatagccaaagttttcgccaaaccaggcacaccttccaagaggacgtgtccatcggaaagtaatccgataagcagtgattcaaccaaatgtttctgaccaacaatgatttggtccatacctgtcgtaagattggtaacgaaagcactttgtctttcaatccgctcatttagctcgcggatatcaattgattcagccataaatacttaatattttattatttaaatcccattaattttatgtaagccttgcctgtgtcataaggctttttattttgccccaaaagtacgccatataattaacgattgcaactaatttttattaaaaaacaatgcgaaatctttagattaaggtactttcatacgcttttgtatatccataacacttcacccgaccaatacaggatttgcatggtcgggtgaatggattataactacttattcttttgtaagttctggtatttcaatagttgtgccatacggtacattgttggggttcttaataaccttcggattgtgtttcacaatgtatggccacattgcctttgtaccataaaaacgcaaggaaaccctagtcaaagtttctccttctttgattgtatattttgtcttggttcccgtaatcttataagatgctgaatccagataggcagaagtagcaggttgttgtgtaaccgtttgaggttctgctttgacaggaatagcttcttcttttttggcaaccggttgtgtcgtggtagcgactttggatacatcaggcgttattacctttgtagtatccttatgtgcaatcgtatcagaaagctgcgcttccggttgaacgggttgagtggtcacaggcggcatatccagtgcattcttgtcagatgaagaagagaataaatccggataataaataaaaagaatgacacctccgcataataacaaaacgactacaataacagctattaaataaggtacaggagatttttccttcaccggggctgtctttttagaaaccggttgggatacttgttccggttggaccggctttatcgtttctttttcagcaggaggcactataggagtcacaggttgcagatttgcttttagaagctcttgctctataatcttttcggcagtgatcttttctttttcttcttctatagatgctggttgctgctcatcgatcgtcacttcctcctccggaacctcttcatcttccaactgttctaccttttcttcgatattagtctctgtaatgatctcttcagactctttaggagatgtctgttctgtcaattcctgtgctattgcagattcctcagtaatagcaggttcttcaatggactcttccacaagtggctgactggctatttgctcttcctgaatcggctcttcttccgaaagaccatcatcagtaccttcattttcttctatcacagtagtttcagagtcatcccccatctcattcaagactgcctgtgctgatgcttcctctcctgtttcttcttcctcagtctcttctatcggagtatcttccagaattgtattttcattcaatacaacagtctcaaagtgtgcaaaaggtttatttatcgtatcccttagatttgcatccggagaaaatgagacttttgtatgtccttttatctggaaacgctcgcctgtgttgacattgacactttcccggctatctacatcaataagtttgaaagttcccaatcctttgatttttacagtcttttcgttctccaaggcttgttctatcaagaggaaaaactctttaacaaacgcttcggcgtctttcttggtcatgctatgtttggctgccaataagtcagtaaggtcttgaattgttagtctttcattcataacgggaaatatttatttaaacttatctttcaatgtattgctaggtctatacgataataccaatttaggtggaaccagcatgcgttgtttgcttgccgggttgattgaaatccgttccgctttctttttcacttcaaaagaaccgaatccttgaattgcaatcacattaccttcttccaattcttgtgtcatactggacaacaaagaattcatcaattcggaagtatccttgattgtgtatcccaatctttccgctagttcggatgtaaattccttattattcatagtcatttataatctttgcatataaatcaaaatcgtccgcattcaccacttctacctgataaaactgtccgatcttaagttctctctctgaacgatcaatcaatacttccggatctacttccggtgaatcaaattctgtccgtccgatataataatctccttccagacgatcgatgatcactttcatctgtttaccgatcttttctgcacttaactctgccgaaataccttgctggatatccatcaattcatcaagtcgggcttgtttaacctcttgtggaatagaatcttcgtatgtttctgcagcataagtcccttcttcttcggaatatgcgaaagcacccattcgatcaaaacgtactttacgtacaaattctttgagatcctcgaagtcttcctcggtttctccgggatgtcctaccattaaagtcgtcctcaggtgaatgcccggcacttctctgcggaattgttcgatcaattggtaagtatcctctttgctcacttgtcggcgcattaacttcaacatattgtcactgatgtgctgaagggcaatgtccatgtatttacatacattgtcacgttcgcgcataacccggaataaatctgttgggaaatgtgctggataggcataatgcaagcgaatccattccaccccgggtatatcagaaatacgctcaatcaattccggaagcatttgtttcttataccggtctatgccgtaataagtcaattcctgtgcgatcacctgaaattctttcacgccttgcgataccaggtatcgtacttcgtccagaatttcttctattggtttggaaatatggtgtcctgtaataatagggatagcacaataagaacatttacgatcacatccttctgaaattttcaggtaagcataatgctggggagttgtcaatgtccgttcgatatataattcatcgtgatagacctttcccaagtcctgtaaaagctccttccaattaaacttcccataaaacttatctacctgtggtatctcaacagctaattccttgagatagcgttcggaaagacaacccatcacgaaaagtttctttaaatccccttcttcctttctttcagcgaactccagaatcatatttatggattcttctttggcatcaccaatgaaaccacatgtattgattaccgcaatttctccttgcggattttcagtgtcatgagttacgctgtatccgacttcctccaattggcgcattagctgctcggagtcaaccagatttttagaacatcctaaagtaataatatctattgtttttcttttcatgcattttctccaaacaaggaatcaacgaattcatttttacggaatacctgcaggtcttccatgccttcgcctagtccgatatacttaacaggaatcttgaattgatcggaaataccaatcacaacaccacctttagcggttccatcaagcttagtgatggccatagcggtaacttccgtcgccaaagtaaattgtttggcttgctcaaatgcattttgtccggtggaaccgtccagtaccaataaaacttcatccggtgcatcaggcactacctttttcatcacattcttaattttggtcaactcgttcattaagcctaccttattgtgcagacgaccggctgtatcaataataaccacatctgcgttattggcaacggccgaactaagagtgtcataagccacagatgcgggatctgctcccattttctgtttaactacgggaactcctacccgttctccccaaatcattagctgttccacagctgcagcgcggaaagtgtcagcggctcccaagtaaacggatttacctgctttcttgaattgataagccagtttaccaatggttgtagttttacctaccccatttactcccacaaccataatgacataaggttttcttgcgatgggtacgtcgaaatcagctacatcacccgaattattttcagtaagcagagctgctatttcgtcacgtaatataagattcagttcctgagtatttacatacttatctgcagcagcacgtttttcgatgcgcttgataatatttaaagttgtttctacgccgacgtcagatgtaatcagcacttcttccagattatctaatacttcatcgtctacttttgacttgccagccacagcacgagctattttactgaatacgctctctttggttttagataatcctttatctaaagtttccttcttctcctttgaaaaaaaactaaaaaatcccatatttacacttgtttgtataatacatttgctacaaagatataacaaaggattggaaaagtaaaaaaagaagcaataaaaaatcccctcattgttcgccaatgagaggattttgcagttatagcgtatatgctatttcgattattttttgaaaaagtcttgtactttttcgttcggaaccatttgttcatcaaaaacgtatgctccagttttcggagattttaccattttgataaccttggtataagcacgaccttctttagaaccttcgtgcaaacttgctactgttttctttgccatgggttatactactttattatttaatttccttgtgtactgttactctcttcagaatcgggttgtattttttcaactcaagtctttctgtagtattctttctgttcttagttgtgatataacgagatgttcccggcattccactgtctttgtgttctgtacattccagaatcacttgtactctgttaccttttgctttctttgccattgtaagttttctcctctacgtttagccgattactttaatgcttttccaatcacaataacctttagccactgcttcagtcagcgcagcatccagtccttttttgttgataatacgcaacccgttagcacaaatgctaaggctgatccaacaatcttgttctacataatagaactttttgttaaacaagttcaaatcaaaggttcttttagttcttctctttgagtgtgaaacattgttgccaatcatggctttctttccggtaatttgacaaatcttcgacatttctatcttatttttatagttttatatctatacttctttcaaacaggacgcaaagtaagcacttttatccgtataaaacaagaatttcctaaaataattcacttccaggcacctatttttctttatttgagtaaatcacggagcattaatagtgcattattgcctgctctttcgatattcatgcttcttccgcggttcgtttcctgtttgtaagtacgaatttcgtttttataaccagcggctatccaaacagttcccaccggcttctcgggagtaccccctccaggacctgctatccctgaagtagcaacggcgcaatcggtttttagtgctttcatcgcaccttttaccatttcaatcacagtttcttcgctgacggccccatgttgctccaatgtttcggaggaaacgtgtaaaagtcccatttttacttcattagaataggctactacgcttccgttaaaatattcagaactaccggcaatggaggtcaaacgtgcggcaatactgcctccggtacaactttctgcggtggaaacggtcaatttcttcttttttaaaagttcaccgactataacttccaatggcgtatcttcttcaccgaaaatgtcttcaccaagtattttctctaattttaccttttcacgttcaagaagaacttttacttcttccctgttttgtccgcgtcctgtcagtctaagacgaataatccccagcttaggcaaatatgccaatttgatacattctggcagagcactctcccacggttccagtttttctgccaatacggattccggatagtgttgtacaagaaatgtttgatgcataatcacatccgtttgaaacctctcgtgcagtttaggtaatacactttctgtcattacggcagtcatctcttgcggaacgcccggcatggaaacaagtacctttccatctctttcgaaccagctgacagaagcacttcctacaggattatttatcactgtacaatctttcggaaccattgcctggcttttgttgagtgcattcattggtattttccctgccagtacccgttttacattttcgaatacttcttcgctgaaaaccagttctgtatgaaagtatttgcataaagtttgtttggtgatatcgtctttggtaggtccgagtcctccggttactaaaacaatattcaccctttccatcgcattatcaatcgcttccaagatttccttttcccggtcacggattgaaacaatacgaagaacctcaatgcctattttatttaattcctgccccatccaggctgaattagtgtcgacaatctgtcctatcaacagttcgtcgccaatagttattatttcggcaaacatacttcttagtttttatcttatatataattaaggtataccttattataacgtcacacgagaataagccggaagatcaatagaacaaaagtccttatccagatatttgaaatatccggtaatggcgatcatggctgcattatcagtcgtataactgaatttagggataaaaatgttccagccatatttctcggcatgttcccggaaagcattacgcaatccattatttgcagaaactcctccggccacagctatttcattaatcttatattctttggcggcttttcgtaatttatccatcagaatatccactacagtagcctccaatgatgctgcaagatctactttatggtgttctatgaaatcaggatcttcctttaaccagtcgcgtaatgaatataaaaaggaagttttcaatccgctgaagctgtaatctaaaccaggaatatgcggtttgctgaatgtaaaagctttcggatttccctgacgagccagtttatcaatgatcggtccgccgggataaccaagtcccatcactttagagcatttatcaatagcttcacctgcggcatcgtcaatagtctgtccaagaatctccatatcattataggctttgaccagtatgatttgtgaatttcctccagataccagcaaacagagaaatgggtaaacaggttgtctctcttcttctccttccgctttaataaaatgagctaaaacatgtccggtcaaatgattaacatcaatcattgggatgtttaaagaacgagcgaatccttttgcaaaggaggctccaacaagcaaagaccccatcaatcccggtccgcgagtgaaagctaccgcgctcaactcttctttggtgacgccggcacgttttaatgcttcatgtactaccggtacgatgttttgttggtgtgcccgtgaagccaactcgggtactactccaccgtatgcttcatgtacggcttgacttgataccacatttgacagcaaataaccatccttgattacggctgccgacgtatcgtcacaggaggattcaattcctaaaattattgcactcataagtatttaaactattaaacggtgcaaaagtaatcataaaactacgattcgtaacgaactattttatatttttgttcgcaaaataaaagttatcgcatatcagaacgctgaaaaagactgtacgctgggtagtaggtattgtactgggagtatatatcgggactattgttttgctgaatataccaaacattcagcaagcaatgagtgtatttgtagctgaagaactttctgaagttttaaatacaaaggtagtgattggtagaattaatatgggtctattgaaccgtattattattgatgatgtattgcttgacgatcagagtggtcaggaaatgctcaaagtcacacgtttgtctgccaagttcgatattatgcccttttttaaaggaaagatatccattagcagtgtccagcttttcggatttaatatcaatctccggaaagagactccggattcccctcctaattttaagtttgttttggatgcttttgcttccaaagataccgtgaagaaagaaaactcccttgatttgcgtattaattccatcctgattcgtcgtggaaggatgtcttatcatgtgttgtcggaagaagaaacaccggggaaatttaacgctaagcatattcagcttcaaaatatcatcgctaatatatcgctgaaggcattaagtaaggactctttgaatttagggatcaagcgattgagccttgatgaaaaagcatccggcttctctttgaaaaaaatgagtttgaaactggttgccaataacaagcagacaaacattgataattttacaatagaattgcccgaaacctctctcaagcttgataccattcatttggagtatgatagtttgaaagcttttgaccgttttacagaacaggtgcatttctctttccgtactttgccatcgcaagttactttaaaagatatttctccttttgtccctatcctctcgcatttcaaggaaccggtgacgttggatatggaggtgaagggaactgtggatcagttgacttgttcgcatctggagattacagccgatgaccgtcagttccgtctgcgaggagatgtatcgcttcaggacttatcgcgtccacaagatgcgtatgtatatggaaccctttccgaactttcggccaatacgcgcggagtcggttttttagtgcgtaatttgagtcctaattataatggagttcctcctcttctcgaacgtttgggcaacgtgagtttccagggagaaatttcgggatacttcacggacttagttacttatggacaattacaaacgagtcttggaaatgtaaagaccgacttaaaattgagttctgataagacaaaaggattgtttgcgtattccggagctgtcaaaacagaggattttcaactaggtaaattattggataatgaggaattgggagaaattactttcaatctggatgtacatggccggcatattgctgaccacttgcctgccgtagaattgaaaggactgattgcttcgatagattatagcagatatagatatgaaaatatcacactggacggagaatacaaacaaggcggatttaatggaaagattgcgttggatgatcctaatggctctatttatctgaatggagacgtaaatgttgcatccaaagttcctacttttaattttcttgcagtagtcaataaagtacgcccacatgatttgaatcttacgaccaaatatcctgatgcagagttctctttaaaactgaaagccaattttacaggtggatcagtggatgagatgattggagaaatcaatgtggatagcttggaatttacagctccggataaagcatatttcatgcagaatatgaatatccgggcaaccaaacaaaatggagaaaatcagcttagattgacttccgaattcctgaaagcaagcatagagggaaaattccaatatcacacattgcctgccagtattctgaatattatgcggaaatatgtgccgtctttgatattacctcccaagaagccgattgaaacccataataactttttgtttgatatacatatatataatacggacattttatctacgatatttgatataccgttaacggtatatactcattctacgttgaagggatattttaatgatgctttacaacgcttgcgtatagagggatattttccccgtctgcaatataagaacaactatattgagtcaggtatgattctgtgcgagaatccggcagatcatattcgtgcacgggttcgtctgactaatttgaaaaagaaaggggcagtcaatctatctctggatgcacaagctaaagatgacaatgtcagtacgactttggattggggaaataatgctgcagcaacatatagcgggaaattagcagctgttgccaaatttctacgtacaagcggagaaaagtcattgttgaaagcgatggtggatgtgaatcctactgatgttattttaaatgatactctctggaagatacatccttcgcaggtggtggtcgattccggacgagtggatgtgaataatttctattttagtcatcaggataggtatgtacgtattaacggccggctttccgagaatcctaaagatactgtaaaggttgatctaaaggatataaatatgggatatgtatttgatattgcaagtatatccgacgatgtaaattttgagggcgatgcaacaggaacggcttatgcaagcggagtgtttaaaaagcctatcatgaatacccgtttatttataaagaatttctcactcaatcacggtcgtttgggtgaactggatatatatggtgagtgggataatgaaaacagaggtatccggttggatgcatccattcaggatatatctccttctccgtcgcgtgtcacgggtattatttatccattaaaacccgagagcggacttgatttaaatattgaagcaaatgaattgaatctgaaattcctcgaacattatatgaagtctattgccaatgatattaaagggcgaggaacaggaaaagtacatttctatggaaaatttaaaggattgaacctggatggtgcggttatgacagatgcatccatgaattttgatattttaaacacacattttgcggtaaaagatactattcatttggctcctaccggattgacattcaataatatacatatctctgatatggaagggcattcggggagaatgaatggatatttgcatttccagcattttaagaacctaaactatcgtttcgagatacaggcaaataatatgcttgtgatgaacacaaaagaatcgacagatatgcctttctatggtacggtatatggtaccgggaatgtattgctctctggaaacgccatacaggggctcgacgtaaatgtggctatgactacaaatcgaaatactacctttacatatattaatggtagtgtagcatcggctactagcaatcagtttatcaaattcgtggataaaacacctcgtcgtactatccaggattctgttcaagtaatctcatattacgaacaaatacagcaaaaacgtcaggaggaggaagagcagaaaacagatatccgtttgaatattctcgtggatgcaactcccgatgccaccatgcgaatcattatggaccctattgccggagattatatcagcggaaaaggtacgggaaatatccggacggaattttataataagggcgatgtgaaaatgtttggtaattaccggatcaatcaaggagtatataaatttagtttgcaggaagtgattcgtaaagactttattatcaaagatggaagtacaataacgttcaatggtgcacctttggatgctaacatggacatacaagcttcatatacagtgaactctgcctctttgaatgatttgataccggatgcttcggctattatacaacaacccaatgtgcgtgtaaattgtatcatgaatctaagtggtatgctggtacgaccgactatcaaactgggtattgagcttccgaatgaaagagatgaaatacaaacattggtacgtaattatatcagtacggaagagcaaatgaatatgcagattctttatttgctgggtattggcaagttctatacggaagatgcccgtaataataatcagaattcgaatgtgatgtcatcggtgctctcatctactctctccggccagttgaacaatgcactttcacaggtctttgaaacgaataactggaatatcggtacgaatttgagtacgggtgataagggttggacagacatggaagtagaaggtattttgtcgggacaattattgaataaccgtttattgataaacggaaacttcggttatcgggataatccgatggctaatactaactttgtaggagactttgaagcagaatggctgattacccgttcgggagatattcgtttgaaggcttataatgagacaaatgaccgttattacacaaaaacaaacttgactacacaaggtgtaggtatcatgtataaaaaggatttcaataaatggagtgatctatatttctggaataaatggcggttacgcaataagcggaaacgggaagaagctgaaaaggtgaaaccgcaacaaacggacagcatcactgataaaactgataaatcggcagtgaaaagaaaacgtgtacaggagcagtaaaaaataataaacgatgacatatccaccaggaattatgtcatcgtttgttgtttgtgagaattatgtttcagaattatgcactttgacctatgaaaggacagtaccgttctcgcctatgtttactactttatctacatcccccttctcaagttcaattcgataatatatgctaccatctgctttttcaatatactccgcttcgtcaaaacgatattctccatattgattattgagagtattgtttactgcttcaggcaattcattctgacgtatttcccatgaagtagaataccaatttccagtctggttgaacaatacatcttttgagattccattatgaatgatatctacctctgtaaatccaaaatcccaatcatttctatcatcttcaacgtctacttccatgattcttgcattcggatacttttcattgatgaagtttttcatagcttcagtcaattgtacaggaagatgttcgctgttatcatcatcagtgtctacaatgcttttaatcagagttccatcagcagaataatacaaatcgacctcctgattctgcttttcgacttcaattacgaaaacagtttcaacgcctgtccgttccagtttgtctatatcatcccgcttccatgaggcatattcgctgttctcaaaagacatttttactgcttgtggtaatgcattgtaaggaatgtccgtttctgtcatttgccatttaccatcttgggtgaaccatgcagatgcttcatatccgtcatagaaatctgctacataatatccagacttagtttcccacttcacatttgcagcattagggaatttggatgaaaatgcactttgaagttcggcaggaacagctattgaaccatcgtcatcgttgtcacaactttgcagactccatgtgacgcttagtgccagtaaaagtgtataaatctttagtttcatctttgttcaatttaaataggtttagaaatcaatatcaatcaaattaaatttcaggtcaaacttcagttccgtacggttggacagttttacttcataatctttcttatctctctcaatttttagaattttagcatcagggtaattggtcgttacgtatttctgaatagctgccggaataattgctgtaggtacagaactatatttgcagttcacttcttcccagttgcctttgttgtcaaactccactttatcgccattcgtgaaaatcacttcataacttttataaaagaaatcactctccattttggctaatgctactttgctgtcggcaaaatgctgtttgataaactgctgtgccggttgtggcatttgagttacctggattggtttgtcgtcatctgcacgagctactgtttgcaaagtgaaaagacacactaataagaatactaactttttcataatcgttgttttttaatattggtttttactattattattaatttgataatgcaaagatgagaggagaatctgaaaagatttgggaattttgagaatttccgaaaaaaaatcgaaaaaatatagtgacgctatccggttaacatagcgtcactatatataaaggataccgtcaccatcctatagggatagtgtcactataatttcttcctgaaattagattctttaggattcttttaaaactactaatagatacatcgtttatttttgcacacacaaatttgacaatattcatattaaacaaccataagaacttttgtatgactatgagaacaaattattttttattattagctattctattggggattatccctatgagttacacgcacgccaatgattcaatacctaagagcgtgattctgtacacaccttacacaaaaatctccgtatctcccggagcgtcaattgactacagtattgatcttatcaacaacacggaccagttgatgaatgcgaatctttctgtcagcggattgtccgccagttggaaacacgaaatgaaatccggtggctggagccttagccaactatcggtacttcccaaagagaaaaagactttcaatttaaaagtcgaagtcccattaaaagtgaataaaggtaattatcactttgtagtatatgccggaaacgccaaacttccattggatgtggtggttgctcaaaaaggaacataccagactgaatttactaccgaccaacccaacatgcagggaaattctaaatcaaccttcactttcagcgccactttaaagaatcagactgccgaccagcagctatatgctttgatggctaatgcacccagaggttggaatgtagtttttaaacctaattataagcaagccacttctgcacaagtggaagccaacagtacccaaaatgtaagtatagatattactcctcctgccaatgtagaagccggcagttacaaaattccggtacgcgctgctacaggtaccacttccgctgaattggaactggaagtggttgttaccggctcttatcaaatggaactgactactccccgtgggttattgagcacagatgtcacagcaggtgatataaagaaaatagaactggaagtcagaaatacaggttcttcattactgaaagatattcagctgtctgctaataaaccagctgactgggaagtaactttcgaaccttcaaaaatcgatgcactaaaagccggagagacatcaacggttatggctactttgaaagcttctaaaaaagcattgccaggcgactatgtgactaccatcatggcaaaaactcctgaagtaaatgccgatgcgcagttcagagttgcagtaaaaactccgatgatatggggatgggtaggcgttcttatcattattgccaccatcggcgtggtttactatctgttccgtaaatatggaaggaggtaaattatgggcgaacaagtgatcgtacttaccgatttgaccaaacaatacggtaatttcactgctgtagatcatattcgcctgaatatccggaaaggagaaatcttcggattactgggaccgaatggtgctggaaaatcaactactatcttaatgatgttgggattgacagagcctacttcgggaacagttgaaatttgtggaatcaattctactacacaccccattgaagtaaaaaggaaaattgggtatttgccagaagatgtaggattctatgatgatatgacaggaccggagaatttgatctatacagcgcgattaaatggtatttctgataaagaggcaaaaaccaaggctatggaactgatgaagcgggtaggccttgaagatcagttagccaaaaagacagggaaatactctcgtggtatgagacagcggttgggattggctgatgtacttattaaaaatccggagattattattctcgatgagccgacttcagggattgaccctgcaggtgttcaggaatttatcgaactgattcgctggttgagtaaagaagaaggactgacagtgcttttctcttcccatcatctggatcaggtacagaaagtgtgcgaccgggtaggtttgttcagtaatggccaattacttgctttgatcgatatggcagaattgaaagataagaagcaggaattgtctgatatttataaccattattttgaggaaggaggagaaagacatgaataaagtcaatcatcctttttgggttatcgtcaacaaggaaatttccgatcatgtcaaaagttggcgttttattatactaataggtattatagcacttacctgtatggggtcgctatatacagcactcaccaatattagtgaagccatcaaacctaatgatccggacggttcgtttcttttcttgaagttgtttacggtttcagatgggactctcccctcttttgtgctgtttattaacttcttaggtcccctattgggaatcgctttgggatttgatgcagtcaattccgaacaaaataaaggaacattgagccgtatgctgtcccagcctattcatcgcgattgcattatcaatgcgaagtttgtggctgctttgattgtgataggtatcatgttgtttgtattgggctttctggtgatgggatgtgggctgattgctattggtattcctcctacggcagaagagttttggagaattgttttcttcatcattaccagtatcttttatgtagcattctggttgaatctggctattctgttctcactccgtttccgtcaggcagcgacttctgccttagcatctgtggctgtttggctgttttttagtgtattctataccatgattgttaatttggtggcaaaagggttgagtccgtcacagatggcatcaccttatcagattatcagttatcagaagtttattctagggttgatgcgtttggcaccgagtgaactgtttaatgaagctaccaccacactattgatgccttctgtcagaagtttggggccattgactatggaacaggtacagggagctatccctagtccgctcccattgggacaaagtcttttagttgtatggccacagttgaccggattgattgcggcaacggttatttgcttcgctatttcttatatcatgtttatgaggagagaaatacgatcccgataacctgctcactataaaagacgcagaggacacggagaaacaggtggatggatatacctgacaaattggttttatgataaccgacaggtcgttcacttaaaatccgtgtcctctgtgtttttcagatgaatcttatgattgggaaatctcgaagcaatgttcattctgctcgaagtaatattttatattcagatgttgcaaacgacagatggaatcggctatagctaatcccagccctgtagatccttcttttttgctaccctgatagaaacgttcgaagatatgttccttgttcagcggatgttccactcccgaatttcggaaagtaataccgttcttagtaacggtgattcggatatgtcctccatcaatattatgtacaaatgcatttttcaggaggttagtgagcaaagcaacagccagggattcgttcattgtcaccttgaaaacgccttgttcatctatcgtgacttctatgttgcgataatcataaacttcttcgtaatcttgcagatattgtttgagaagtacattgagttccaattctttggtatccgtaaactgaccattatcaatcttggaaagcaataatagggatttgtttaatttagtaatgtattctaaagtctgatgcgttttcatcagttcttccagttgtttttctgatagcgaatcatcttccatcaacatttccaatcgattacggcagatagcaagtggagtttgtatctcgtgtgaagcatttccgataaactgtttttgttgttcgaacatctgctccgtacgttccacataacgaatggcagcctcatttaatttccggaattccgtgatttgagtatcgttactcaaaggtttatttctttttcctgtttgataaccgtccagccagtgtagaagtacatagagcggtcgcatattccggtaaaatacccatacggaaatgataataatgcagaataataaagctacatataaaaatataatccacacctggatggcatctctcaaatcgtctttttcaatgctgggagttgatactgtcagctcgtggtatcgtccttcatcatctttaaagatagtagtaagaatacgtgccggctcggtctctcctttttcttcaatgtataccatagagtctttatactgaatatcctcccggctttccgcatactctttgcttacttccatcatataatattgattgttggagccattggttttagaaggtagctcctctcctgccaatgcccggataatgatggtttccgaataatcttccaaagcatcatccacttcatcgttgacttcatcgatcatcgtaacataaaagaagatagcccagaccgtcagtataagggtcagagcaagagtaatacgaagaatgatgtaatatattaatttcatggacaataatttctttcttttttattctactatcattttatacccaaatccatagactgctttaatttcaatagttgcaccggaatctttgagctttttgcgaagattcttgatttgtgcatatatgaagtcaaaattatcgacctgatcgatatggtctccccacactgattcggccaaagtgtttttattgattaatctcccagggcgattgataaaatataacaggatatcatattcttttctatttagttccacttcctgctcgttgacaaatacacgatatttatccggttctatccgtacgttgccttggcggatatcaatctctccatcatgctgatggcgacgaatcacgcttttaattcgtgcatttagttcaaccaaatgaaatggctttggcaaataatcgtccgctcccagttctaatcccaaaactttgtcttccagagagtctttcgcggaaataataatcacgttctcccgcttatggagagctttcagtcgttcaagaagatcaagtccgcttccgtccggtagcatgatgtccaataagatacaatcatagtcgtaatcttcaattttgcgtagagcagaattgaagtcactggctgtttctacaacgtaacgttctttttcaagtgaacattgaatcagttctctcaaagagggttcgtcttctacaatcaatatcttcataattttgtctcctttcttttttacatactacaaagaaaagggatatttctgaaataaaactgaaatggattgaaaaaagagtttgaaataactattgaatgtctaatgaactgttaggataggccataaataatataatatggaaggaaaaaaagaaaaggatgaaagcgattgagccgtttccatcctttttataattatgtgcgaattttgtttaataagaacgtgcaaatatcacgcggcaagcagatggtttacctgttaccatacatttaccaggttctttgtctcccggaacaaatgactcgaacggaatacaacgaatggttgctttagtttcttccttaattttttcttcggtttcagtagttccatcccaatgagccagaataaatccgccttcttcgattttttctttaaattcgtcataggtgtctactgttgtaatcttggagttacggtagtccaatgcttttttgtagatattagcctgcatttcttcaagcaggttctgaacgtatgtttcaatgccttcacaggtaactgtttctttttccagtgtatcacggcgcatcacttccatcgtgttgttttcaagatcgcgaccacccataaccaaacgaacaggtacacccttcaattcataatcagcgaatttgaagcccggccgtttgttatctgcattatcatatttcacagagatacccaatgctttcaacttagctacaatgccttctactttagcgtcaatttgtttcagttgttcgtcattcttatagataggaacgattactacctgaatcggagccaaatgtggaggtaataccaatccgttgtcatccgagtgagtcataatcaatgcacccatcaaacgagtagaaacaccccatgaagtagcccaaacatactccatcttgttttccttgttaacgaactgaacatcgaatgcctttgcaaagttttgtcccagaaagtgggaagtaccactttgcaatgcttttccgtcctgcatcatggcttctattgtgtaagtgtcaagtgcacctgcaaaacgttcattggctgatttcactccctttacaacgggaacagccatatatttttctgcaaattcaccatatacattcaacattctgattgcttcttcctctgcttcttcacgggtagcatgagcggtatgtccctcttgccacaggaattcggcagtacgcaggaaaagacgggtacgcatttcccaacggaaaacgttcgcccattggttacagagaataggcaggtcacggtatgactgaatccagttcttataagtattccagatgattgtttctgatgtcggacggataatcaattcctcttccaatttagctgcaggatctactacaactcctgaaccgtcttccgcattcttcaaacgataatgtgttactacggcacactctttcgcaaacccttctacgtgttctgcttcgcggcttaagaatgatttcgggattaatagcgggaagtatgcatttacgtgtcctgtttccttgaacatgtcgtccaattgacgttgcattttctcccagatagcgtatccgtaaggcttaatcaccatacatccacgcacagcagactgttctgccaaatcagcttttaccaccaaatcgttataccactgtgagtagttttcactacgtttggtaaggtctttcagttcttttgccattatatttttctatttaaagttttcttgagtgttaaaacagggtgcaaaaatacgaaaaatgcatgaactgccctattcttcatgcattaattttctaaagtcatgtacttctatattacatatctcatttttcatattcgttatatagttgcatccgcgactgtgcttgttcagcatagcgcttttttgagaactaaaggcactatgacccgatgaaaaggttttatacaaaagaaataagcctttcctacccaattatggtattttactaatgtggtaacctcaatcatttgttttcctgtttccaatggcgtaatgaaaatatcgacataaaacaataaatgtttatcgtcttttctcataattgcttcttgcttgtcttcctctataataagttcttcactttcaatagctttagtttctataccgaaaggtttgactaaacaggcccttattgcatacaacattcggagccaagcggggttatgagcaaagacttttaaaataatatctttaggagacaaacgattttctgtaacttctatggaaaaactgtcactgtaatctacggggagatatttctctattttcttagccatattggttattcaattagggttattctacaatatgttcagtttaggtttcgtccgataatagataaaaccatagaaaagggggcttgaaaaataaaaaatcaggcagtttttttttaagataaccacctgattttcaaaagagcggtaaacgaggctcgaactcgcgacccccagcttgggaagctagtgctctaccaactgagctattaccgcatatttactgcatttctcgactcaaaagccttatgaaatggtgatgcaaaggtaaacataatttttatatctcaaataaaatcgcagaaattttaatgcaagaaaaaagagaaattaaagcctcttcaattcttttgttttgatgaaaaacaaccggatatgaaaaaacgcatattagtagcccgtataattaaaaatatacagattggcgatagtcgctatagaaaaaattccaggatttccggttaataagattcagatataaactattttagtgaataatctatcactaggttctaaatagagaatgaatattgaatatgtgagaacaaagttgcttatattatttcaaattgacagatttagtttctagcaaaataaataagatttagagacaaactggtactttatgggctgtttggtagctttcttttaaagggagaacacgcttctcaccgaccaacggttggttccatttaaaggaacggagcttttcctttaaagaaacaactccaatatgcatttatattttgtataatcaagtagtttatatccattaataacacgcttattgcatatacttgcattatttttatgcatcattttttctatctgatagaaatgacacaagcatgattcaaagagaagatgaaaaatagaacatcttataaaagagcgttgaaaccttcttttgttgtattgctatattctttctgatgaacaaacctctcttttcatctgttagaatatctcaaattcagatataacctaaccagtatgaaaaaaaataagcgactttgtatactattgactttgtatttttccatcggtcagatagatgcacagacaccattaagtttcgaagaatcactgcatctgttgaatcaaggaaatcagagtctgaaaatagcggataagagtattgagattgcgaaggctgaacgtgataagttgaatgctttctggtatcccagtcttcagtctacaggtgcgtttgtacacatgtcggagaagatcgaagttaaacagcctttatcgcagtttaccgatccggctaaagactttgtacattccattattccggatgaccagatcatttcgtctatactggatcaaattggggcaaatacccttatatttcctttgactccaagaaatttgacaactgttgatttatcagccgagtgggtactcttttccggtggtaagcgttttcatgccaccaacatcggaagaacgatggttgatctggcacgggaaagtcgggcacaggtatcggccaatcagcaaagtttattggttgaaagctattacgggcttcgactggcacaacaaattgtgacggttcgtgaagaaacctacaacggattgaagaaacattatgaaaatgccttgaagttagaggcagcaggaatgattgacaaagcaggaaggctttttgcccaggtaaatatggatgaagccaaacgtgcattggaagctgcgcgaaaagaagaaacagtagtgcaaagtgccttaaaggttttgctgaataaaaaggatgcagatgccaatatcattcctacctctcccctttttatgaatgattcattgccacctaaaatgctatttgatctttcagtaaacagtgggaactatacactcaaccaattacagctgcagcagcatattgccaaacaagaagtgcggattgcccaaagcggttatttgccgaatatagcccttttcggaaaacagaccttgtattcgcatggcattcagagtaatttattaccgcgtaccatggtaggcattggttttacatggaacctctttgacggactggatcgtgaaaaaagagtgcggcaatcgaaattaacggaacaaactctggctttagggcagatgaaagcccgtgatgatctggctgttggggtagataagctttacacgcagctggaaaaggcacaggataatgtaaaagctttaaatgcaacgattgccttaagtgaagaattggtacgcatccgaaagaaatcatttacagaagggatggcaacttctaccgaagttattgatgctgaaaccatgcttgccagtgtaaaagtggctcgcctggcagcatattatgaatatgatgtggcactaatgaatctactctcgctttgtggcacaccggaacaatttgcaaactatcaacctaaaccgtaacaaacaatgaaaccaactagtaaaaccctatcatgggcttttgtcatcattcttctggctgtcggtattttcaccggcctgggagttatattaatgcataaacagccgctggtcttgcagggacaagctgaagcaacagaaatccgtatcagtgggaaacttcccggccgtatcgacactttcttcgttcaggagggagactgggtacaccagggagatactcttgtcgtcattaatagccctgaagtacatgccaagtatcaacaagtgaatgccttggaacaggtggcggtgcaacagaacaagaaaatagatgccggaacccgtcgtcagatcgtggctactgcactgcaattatggaataaaacgaagagcgaccttactctcgcccagacaacttacaaccgtattcttactttatataaggacagtgtcattacttctcaaagaaaggatgaagtagaagctatgtataaagcggctgtagcagccgaacgtgctgcctatgaacagtatcagatggctgtagatggtgcacaaaaagaagataaagcgtctgctgccagcatggtggatgctgctcgaagcacagtggatgaagtctcggctttgctggtcgatgctcggttgaccgctccggaaaacggtcagatagcaacaatcttccctaaacgtggagagttggttgcaccgggaactcccattatgaatttggtggtgatggatgatatacatgttgttcttaacgtgcgtgaagatctgatgccgcaatttaaaatggacgaaacatttgttgcggatgtgcccgctatcggtaaaaaaaatattgaattcaaaatctattatattagtccgctaggcagttttgctacctggaaatcaaccaagcaaaccggaagttatgacttacgtacctttgagattcatgcccgtccaacccaaaaggtggatgacttgcgtcccggcatgtccgtgttattgactttagattaatcgacatcaaatagaccagagaatggatgaatcacaaacatattccccttttcgttccgtactgctcagagagtggcggcgaatgacttcacggcgcctttattttggtgtctgcattgtcttgccattgttcacccttttctttatggctacgatctttggtaacggacagatggaaaacattcctattggtattgtcgatcaggataatactgctacttcccggacgatagtcaggaatatttctgccgtaccaacttttaaagtgacaaagcattttgtaaatgaagcagctgcccgtgaatctgtgcaaaagaaagagatttatggatatctttccatacctccccaatttgaacagaatgcgattgccggaaagaatgcaacactctcctactattatcattatgcattaatgtcggtaggtggtgagttgatggcggcattcgaaacttccttagctccggtggctctttctcctgtggtgatgcaagcgatggcactcggagtagaacaggatcagattaccacctttttattacccgtacaagctaataaccatccgatatataaccctagtctggattattcggtatatttaagtcagccctttttctttgtgctgtttcaggttttgattctgttgattaccgtgtatgcggttggcattgaaatcaagttccgcacagcagatgattggctggcgactgcaaaaggcaatatagtgacagctgttttaggtaaattattaccttataccattatatatatactgataggatggttggctaattacgtcatgtttggtattttgcatattccttttcaggggagttggtggttaatgaatatcatgactgtgcttttcatcattgcaacacaggctttagggctgtttttattctcgctgtttccggcaatatcgttggttataagtgtagtttctatggtaggttctctgggggctactttgtccggagtaacctttccggttcccaatatgtatccgttggtgagggatgcttccaatttgttccctgtccgtcattttacggaaatgatgcaaaccatgctctatggaggcggtgggtttatccatctttggccgtcggctgtgatactctgtatcttcccgttgctggccctgtcgctgcttcctcatttaaaacgagctatagaaagtcataagtatgaaaacattaagtaagttacaacagttgtcattcatcattcgtcgtgaatttctagctatcagtaccagttatgcggttttactggtgttgatgggaggaatcttcgtttacgggttgctctacaattatatgtatgcaccgaatattgtaaccgatgtacctgttgccgtagtcgacaattcgcacagtgaattgagccgtgattttatccgttggctggatgctactccccaagcagagatttttagtcaggctatggactatcacgaagcaaaagaatggatgaaagaaggcaaagtacagggaatactctacctgcctcatgattttgaggaacgggtgttccggggagatgaagccgtattttccctttatgcaactactgatgccttcttgtatttcgaagctttgcaaggtgcttcttcacgtgtcatgctggctattaatgataaataccggccagatgaagcagtgtttcttccaccacaaggattgctcgccgtagctatggcgaaaccgatcaatgtggaaggcactgcactctacaattataccgaaggatatggttcctatcttattccggcagtcatgatgattataattttccagaccttgctgatggttattggtatggtgaccggagaagaatacagtagtaaaggaatccgtgcatatactcctttggggtatggctggggagttgctattcgtatagtggcaggaaaaacgtccgtgtactgtactctttatgccatctttgccttttttctattaggcttgctccctcactttttcagcatccccaatattggaaacggattgtacatcgtactattattgattccatatttgatggcaacttctttcttgggattggctgcatccaggtattttacggattctgaagctcccctactcatgatcgccttcttctccgtaggattaatctttctttccggcgtttcctatccaatggaactaatgccctggtattggaaagtagtccattacattttcccagctgcaccaggcacactcgcttttgtgaaactgaattctatgggagccagtatggctgatatcagaccggaatatataactctctggatacaggcacttatttattttacaataagtatatgggtctataagaagaaactggaatcaaatctgattagttaaattaacaaaaacaaaacatgcgctaattataacatatagcaaaagaacactttcagataaatcaacttcgcaaagtaaataatcaactttggaaataaaaatgtttctaaatagatgttttcttgtagaatctctcctatttctttgcatttgtcattgtttttgtctagtttcgttaactgttatgtttatatgatcgttagaagtagtttaaaaaacaactatttatatgaaatacattgtatatattcttctcttttttcctgtttgggttacagcacaaacatacaaatatataggaatagaagatggcttgagcaatcgccggatattcaatattcagaaagatgctcagggctatatgtggtttcttacaaatgaagggatggaccgatacaacggtaaagatataaaacactataaattaaataaagaaggcactattttggatgctcccatacgtttgggatggttatatacagaaccacatatcggtatatgggtggttggcaaacaaggacgagtctttcaatacgaagccgacagagacgatttcaaaatggtatataaattaccggatacctctgaagcaataagttgtggttatctggatcgcaatgataatatctggatatgtcgtaaagatactgtattgctgtataatattaaagatgctcatatagttcgatttcccaatgtattgtatagtagtattacggcaatagaacaagtagatgagcaccatttctttatagcaacggagacgggcgtacgatatgtcaaactggagaatggtattttagagaccatgcctgttgaaacactggactattttcatgcacaggtgagtgaactgtattttcatcggcaattaaaaagattgttcattggttcatttgaaagaggagtttttgtgtacgatatgaatacacaggaaattatacgtccggacgctgatcttagtgatgtaaacatagctcgtatcagcccattgaatgaaacagagttactgattgcaacggaaggaataggggtgtataaagttaacgtaaatacctgtgaactggaagattacattattgctaattatcagagttataatgaaatgaatggaaataatatcaatgatgtttttgtagatgaagaaaagcggatatggcttgctaattatccaacaggaattacagtgattgataatcgctatgaaaattatcattggatgaaacatgctatgggtaatgcacagtcattaatcaatgatcaggtacaagcggttatcgaagatcatgaaggtgatctgtggtttggaactagtaatggtattagtctttataattcaaaaacaggtcagtggcattcatttctaagctcttttaatcatcaactaaaggacaagaatcatatatttattactttatgtgaagtggctcctggcattatatgggcaggaggatatacttccggcatttataaaataaataaagaaacgctatcagttatacttctctccttaccttctttctcacgtcaatatgcgtccggataaatatattcgtgatatagttaaagattcaagaggacatatctggtcgggaggctattataatctaaaatgttttgatttggagactaacagtgcacgtctatatccgggactgaattccataacatcaattgttgaaaaagacaaagataatatgtggatcggaactgctgctggcttgtatttattgaatcgaaatactggtgaatatcagtatattgaaatggagataggaatcacttatattaatacgctttatcaggcagataatgggttgttatatatcgggacaaatggtatgggagtatttatctataatcctcaagataagactttcgaacattatttttctgataattctgctttagtttcaaatagaatatttacaatattgccggaagtagatggacgtataatgatgagtacagagaacggaataacctgttttcatactaaagaaaagatatttcgtaattggactagaggagaaggcttgttgcctgcatactttaacgcagcggcaggaacggtgcgtaaaaataaaaactttgtattcggtagtacggatggagcaattgaacttccgatgaatgtgaaattcccggattataagttctccagattggtatttagcgactttcatctgtcttatcaacctgtttatccgggtgtcaaggattctcctttacagaaaagtatcgatgagacagatgtattagagctggcttatgatgagaatacgttttcatttgaagtttctacaatcaattatgattctcccggaaatgcactatattcgtggaaattagaaggcttttatgagaaatggactcaaccgggagcaaataatttgattcgttttaccaatttgcctccaggtagatatattcttcatgtacgtgctatatccagagaagaacatgacattgtttttcaggaacgtgctatgaaaattatcatcacgcaacctttttggtcgagttggtgggctatcttgtgttatattctgttggtaatagggggattttattttgttctacgtgtgataaatctaagaaaacaaaagaatatatctgatgaaaaaacgcagttcttcatcaatacggcccatgatatacgtactccattaactttaataaaagcacctttggaggaattattggaagaagagacgcttaccgacaatggaataactcgtacgaacattgcattgaggaatgtggaagttcttttacgactggtcagcaatctgattaattttgagcgaacggatgtatattcctctaaaatgagtgtttccgagtatgagttgaatacctatatgaatgaaatatataattcattctcttcttatgctgccattaggcgtattgaatatacatacgagagtactttcagctatatgaatgtatcgtttgataaggagaagatggattctattttgaagaatataatatcgaactcgctaaaatatactccggaaaatggaaaggtcagcatttccgtgtccgatacgaatgattcatggaaagtgataatcaaggatacaggtataggtattcctgccagtgaacaaagtaagttgttcaagcttcatttccgtgccagcaatgctattaactctaaagtgacgggtagtggtatcggattaatgttggtaggaaaactggtgagccttcatggaggtaaaattagtgtagatagtgtcgaacatcaaggtacgacaatcaaaattgtttttccgaaaaagaataagacttctcaaagtatcagtgacgaagcatcttctaaatttgaggcgttggctcctgtactgcccgctccgaatgtaccggcaaagacaaccgctacgatagatgatccaaatttacgacggattcttgttgtagaagacaatgatgagctacgctcctatctggtcagttcattgtcttctatatataatgtacaagcttgcgctaacggaaaggaagcattgattattatcaaagaatattggccggaactggttctttctgatatcatgatgccagagatgcggggagatgaattgtgtgtggctatcaaaagtgatattgaaatttcacatattcctgtgttgttgctcactgctttgggagaagaaaataatattctggatggactgtcgattggtgcggacgaatatctcatcaaacctttcagcgtgaaaatattacgggcgaatatcgctaatctgttggcaaaccgggaactgttgcgcatgagatatgccaatctggatatagaagcgaaatcaatggttccatctgcaaacggtactaacagcctcgattggaagtttatatcaaatgtaaagaaaatcgtggatgagaatataaacaaccctgaattttccgttaatgtgctctgtgaatcaagtggcatgagccgtaccagtttctattgtaaattgaaagcattgacgggacagtctccgacagagtttattcgggggatgcgtttgaaacgtgctaccgagttattgaaagagggtgaatatgctattaatgagatttcagacatggttggattctctgaaactaaatattttcgggaagtattcaaaaaatactataagatgagtccgagcaggtatgctaaagaaggaggcaatccctctgctgaactggaagatgacgaagaagattgataaataaaaagcgaatagatacgttgtatttaaaaaagttctcctctgttatgggtatctataacagaggagaactttctttttcaaggcttataactcttttcagggaaaagcggttattgataaggaagttatttgcgaatcaaatatctaatgaataaataacctccgaatacttgcaggcacattccgggaattccaatgcggaaatcctgaatggcattgtagaaatttcctatatacatccactctcccaatgtccctacaacttgataggtaagtactacgccaaccaataccgggatggagatacgtccgaaacgttgtgcggcccaaccggcagcaatggcgagcaatacggactttaataaaatagcaggcagcaccaccggcatcggcataccaaaaagtgaggagttgataataggggaaagaacagcagtcagcagaccgactttccatccgtacttataagctccgatcagtgtgaagaaatagataggcagccaggttattcctccttgcggtatgagatgaaaaaattggggaaaaaggatgttgccaacgatgaataacgaggctgccagataagttctcacattgccgtaattcagcgaatagagttttacagtagttgattccatatcattttattatttaaaagttcaaattaataccacccataaacgtagctttgggcatgggataacctgcatttatttcataacgctgtgccagcaggttctctccttttatgaagaggttagcgaaacggcagacacgataattcccacgaagattccataaaacaaaatgatcctgttgctcgctaccctttacaacagaagtataaagtcctttcacatattgtactccagtcgatatactccaacgtccggaagtatagtccgcccctgcatacaatttatgttcgggggcagcaagaacgggattctccatgtgcaaccagctataattggcgttcacattccagtgtgaattgatgtggtagcctatattcgtttcaactccccaattctctatctctccggaattgatattcaatggaggaaagagtccgtttgacataatcagattgtcgccattgatatagtaaaggctgattccataggacaataccccttccagcagacgttgtgaataggaaagttcatagttgattagtttttccggtttcaattccgggttggcaggaggaaacatatacatctcacgaatggttggattacggtatcctttgctgaccattgctttaagttctgcattcttgggtaaatgaaaagccagtccgccttgtggaatccattctgtacctacgtgtgaatggtggtctacacgaatacctgcgtccagtgagaaccaactgctgatatcctgacggaaatcaacgtatccggcaaactcatccatttgcttgtctactcccggagtatgttcacccgtagccagtactttgttccatgattcacctccgaagtgttgataatcaaatcctacggtcaaacgattaccggtaaagaaagtggcactctgataccatgatacacccagcattttgtctttagagttgaaatgtgatttttgcggttcttttcctatctgatagccatcattgattttatgccgtccccagttatagaaaaagctcaaacctcctgaagtcttttcataatgattttccaaagcgaacgatgtcattccacgagtgatacgagaatcgttgtcaatcagtggtacttggatagtccccggattggaagcattaaaatgggttacattcacatctccccatactttccagaaagaactgatatcataacctaactttgcgtatccaccatattgctcgaaccccatatcgggacgatgtccatctgtacgattatatgatccggttacgacgctactgaaacgtcccttcttgacacggttggaaaattcagtctgcaacgtgttatatgaaccgtacccaacttgcatattcgtcttcacaccttcttcctgttgccgacgggtaacaatattaatcacaccacccatggcattcgaaccataaagtacagatgcaggaccacgtaaaacttccactttctctgccatcatagattgataagcatccgctatcggatgtcccatcaaccccatgtactggggatgaccgtcaatcagtaccaataatcccgctgtcggactaccaccgataccacgcaagctcatgccacctgcagctccggtagatacgccatatcccatgatgccacgactggtagtgaataatcccggtacctgctccgttaacaacggcaaaagagaaggctcatatcttttctcaatttgttgcctgccgactacggaaatggtcatcggaagatgacgcacatcggtttcattacgtgttccggtgactacgacttcatcaatcatataatttcttccggcctgtatgctatcctttttagtatgtgtcattcccgagagggaaagcaagctaccgaacaggaataaacaagctgtatttcttctcatactttatttcgtgtttcaagtttcttctttttacttcttatttctgatcttttccagaaaatcgcggatcagtggtaatatttcttctgctgattccacttcactgcacattgtctctacaggacatcctcctgtatggttacggttccagataaaagcaacttcctgcgcaaaatcgactttcacatctgatttccggaatagctccaaagccttggtactgataatatccgtatataattcttttataccacccagaatcatcagggcggcagctcccttgccaaccactttatcagcaatcaaagctcctttaagaaactccggttcctgtgttagcaaatcatagagatcggctacgccacgttgagtgaaagtgcggatttttcctccgttggcaatggtacaggagtatcctcccgtatgtaatagattgattaatttttccatcgtttcttttataaagtaccttgtttcaattgttctacaaactggtcgatccggtgcagttctttcggaatatcaatattttgcgggcaatgagccacacactgattacaaccgatgcaatggcttgcctgtcgaagtttgggcacgctacggtcatatccgacaagaaaagcgcgccgggctttcgcataattttcatcctgtccgcttctggcgacattaccttcattgacacaacggttgtaatgtaacaatacagcaggtatatccagtccatacggacatggcatacagtatttgcagtcgttgcaagggatggtaggatatttcagcattaattgtgccgtttcttcgaggaattctttttcttcatctgtcaatggctccaaaggagaataagtgcgaagattatcctgcagatgctccatataagtcatgccgcttaatacagtcagaatatccgggaatgaaccggcaaaacggaaagcccaggaagcgacactgctttccggacgacgttgtttgagccgtgccaccagattatcgttcaatttggatagacgtcctcccaaaagtggttccataatgatggcaggaatcccccgtttggccagttcgccatagagatattccgcatccgtatttcgagtattggtctctttggcatgtttccagtctacataattgagctgtatttgtacaaaatcccatttaaattcatcgtgtcgtgagagcagataatcatatacttcaatgtcaccatggtaagaaaatccgagattccggatgcgtccggcttcacgctctttaaccagaaaatcaagtattccgttatccaggtagcgtcctttaagggcttccattcctcccatgccgatgccgtggagcaacatataatcaatgtagtcgacttgtagctccgtgaatgatttgtggtacattttgagtgaggcttcgcgagaccacgtatcaggagagaaattagacaatttggtagcgatgtaatatttatcacggggatggcgactcaatgcaatacctgttgccttttcggaaaagccttgtacatatgccggagatgtatcgaaatagttcactccatgagcgattgcataatctaccaatccgtttacggcatcctggtcgataacttcaccattaccatcgggagcaggtttgagcggccaacgcatacaaccatatcccaaaagtgaaacacggtcaccggtggttggagatgtgcggtaagtcattttatcggtgggcacctctccttctcctgttgcgctacttgcagaagtagtcccctttgaagagcatccgtataacagacctgtcgatgtggctgcactgatacctacaatcttaataaaatctcttctatttatatctttcttatttttatcttccataatcttatactgatttagatcaaataattctatgcatctgatgtcctgtcacataaatggcgctgaaaggacgggacggacaaaggttctcacacgccccacaaccgatacatttttctacatttactaccggaatctttggagaatctgttttttcaggatcggaagctaccatctgtatggcacctgtcggacaatggcgggcacagttgccacattccattccatctgtcaaaggtacacagttctctttaatccatacggcatgtccgatctgaatagctgatttctcggcaagactggtgagatgaatagcaccggcaggacaaacttccgaacatttagtacattcgggacggcaatatccacgttcgtatgatatttccggttgcatcaatgtcaataggttgtccgatgggcgcaatacctggttgggacaaacagagacacataattggcaggctgtgcaatgttgagtgaaattgcgtgcgcttaaagcaccgggaggatagatagggttttctctttggggaatctttttatcttcgatagtagccaatcctccgtctacttttttctcttgtgctttcagtacagaagttgttgcaaaaatggccgatgctgaaaggaagctacgacgggcattgtctacctgttcagtagtgacagactttgctttcgtatcttcgctcgtagctgtttcgttcttaggtttccgtcttgtgtatgtaatggctccatgcttacactttccgatgcaatccatacaagtcacacaacggctataatctatttcatgagctttcggattaatacacgatgctttgcaattgcgggcacacaaaccgcaactattgcatttggaagtatcaattaccggtttgaatatcgcatatttggatataaaccctaatacagtacctacggggcagatcgtattacaataggttcgtccgttgcgccacgccagaatgaaaagaacaacaagggtaacaatggcaatcagcatcgtcgaaagactctttatccatacatctacctcataaaaagcataactatccactcgttcggcgaagtacgccaacaggttgtttccccattgccagaccggtgcaaaaagactggaagctatccggccataagcactatacggtgccagcaagatagccaaagagttcaatcctgcaaccatcataataatgaatactcctaaaacgccataccgcaaccatttcattgctggtgaataacggaaccggtttttcttttgtttgccggatacccacgaaacaatgtcctgaaacactcccaacggacaaataacagagcagtagatacgtccgaacaggaatgtaagtacaactaaaaacaatacgacacctatgttcaaggctaataaagccggcagaaattgaattttcgccaaccatccgaaccatgtgtgcaatgtacccgtgaagtcgagaaagagcagggtaataagtgtaaagcacacaatggcggttgtaagtctgatagtacgtagcataaactaattaattttcaatttatagtagttatatctaaatgtctaaaactgtcaggattgaaccatctatatttcaactttgcaaagttaatcagggaaatttgtttttcaactatacaaattacagaatgttttaccaatttcactgataacagacgggaaaacctttagccgattgggtaaagcactatttttctaatgccacgacctctccaatctccggaatcaatacattcagagaatctttattcttcatctcttctgcatttttgagaggttcatcccaacgatgtttggccaacgcatatttagaatgatgtacggtcagaactcttttcgcttttaaatctctggccgtctgtgccatatattggggcatcagatgaattaagctccactcttcgttgtattgcccgttttcaagaattgcgaggtcgatgccggggaaccggttgcctatttctgcataatgcgtatcatatcctccgtctccgccaatgtatatcttttgtgaaggagcttctagcaggaaagaagcccaaagtgactggttggcagtaagtctgcgaccggagaaatgacgggcaggcaaacaatgtatcataaagcccggagcgaggtttgcgtcttcattccagtcaagttctatcagacgttctttatcaaatccccaatattcgaaatgttcgccaacacccaacggacaaatcactgctccaatccggtcttttaattttttgactgtgttgtaatccaaatgatcccaatgatcgtgactaatcacgagataatcaatgtccggcatatcatccggtgtataaagttccgtacctttgaatggcttgttgacaaaagatacgggagaagccatacaaaataccgggtcaaccaatattcgctttcctcccgtttgaatcaggtaagatgaatgtccgaaccataccaatatttcttcattacggccaatcttgcgtaaatccgtttttattgctttgacagcctgttcggggcgcaaaccgtctatctttctgaaaatgaactcccagattccgctaaaacgtcccctgtcggaagtcatcaatagagtttcatgctgatttttaaattctccgtttctgtaattaggagatttcatgactctttccagccgttccccacggggagttctgccgaaactggcttgattgataaaaacaatgactgacaccgccagcaatgctattacagctaatatacatcctacaatcatacgtgctttgaatttcttgaatatgatacgcatataattcataactaaattatttcacgcagcaaatatacaggtattcagagagcttgttagtatatatattacagattgttataccataattactgaaagcagttgcctgttgggtgtcagtctattgtgtgaacaaacccttttcttgttcagttatttagaaataaattttgtagctgatgttcggaatcagacccgctccgtctttttcttctactacactcgttctttcattgtattgatagaaatgcattccggtgcgcatacccacattcagtattttcagagaaaactcgtgggatactcttttcttattgatccggaagctgatcgaaacatcaccgtttatagatggattgaatcgtttagtatatgctttgctctcgtcaaaaacgatgtctttttcttcctgacttttttcttcatccacaggtgtatagcgtcctcctccctgaaagaacagacggccgtttacacttaatacattctgtttgagtctgccaaccatccattcttttccggcgagcaggttcactaaaaaacttttatccagtctcgtatttcgccagatacggtctcctcccctatatttcgatttgaataatgaagctgtaatcatatagtagaagccgtttttcatgtattgttccagtgttatatctattccatagtttttggctattccggtgtttgtcaatatgcggtctaaatagaattcttcataattgataatcgaaaaggaggagttttcctcaaccggtatgtggaacaagtattgataatagggttctattttcagatgtaggctctgattgatattccagtcataagtgaatccgaaatgatgtgcctttgagaagtccaggtaccggtttgattcctttttaccattgattatctgttcaacaaagtaatagtcgagcctttcccggcggctatgcaagccgtaagctgctgctaaagaatgtgcaggatttattttccatttaagggcaactctcggttctatcgaccagttcttgtttaaagtaaaatattgtccggtaacccctaaactggttgtcagattgttgctcaagtttattacggaactactatatgccgagaagactgtactttctccactgcctttcgatatttgttccataggtttgtttaatcccaaataagggctgactttgtaatcaagatcatatttaagttccgtaatggtaatccctgttctgttggtatgcctcggactgaatttcttattcagatatgaattgaatactaaattccatctgctattctgaatatctgctacattaataatagcgtcatcggtatgtaagtccgccaatgaacggtctttggaataggtagcggatagagaagaacggatataagtattttcatccagtacatatttgtgcgctaagccacctgccagtttatccagtttattatatcccgacgaccggtctcccatcgtttcccattcggaacgttccaaagcatccactttattcctgtcggccaatcctaatccccaaattgaaaaggtaccggctttacgtgtgggaaagttcagtttaaaagctagatcctgatatttcaggttgatgtcattgcccgatgccagtgaagtagtggaaaagcgataattcaccagataagagcttcccctttttttgctgataggaccttccgaagctaaatctactcccatgagtccgacctgaaaagcatgttcgtacttctgattattaccatttcgtagatgcatatcgaaaacacctgatagggcattactgtattccgccgggaaagctccgttgtagaaatcggagttgccgataacctgcgtactcaaagcagacaggaatcctcctcccaagcctgatagatcggcaaagtgggtagggttaggtatttcaatcccctccaatctccattgtgtaaattgtggggcatttccccggatagcaaccgcattggtgccgacatctcccgctactcctgcgaatgcagaacttaaccgtgcaggatcgtcaaagccattggcaaatcgtgacgcttcttcgatactaatcatacgtcctcctgtgatggccatcgggttgacggtccggtctttctttatttccggtttgacaagtacttcagccaaatcctgcacattttcatccataggaatttctacaaacacttctttagatgaagtgacagaaacttcgctgatgatacttggacgatatcccataaaagatgcctgaatattataacgacctaccgggacattattgatccgaaagtttccccgtccatccgtcgaacctccccgtgagggatcttctgctatacaaacggaggcatattctatgggcgtattggttttggagtcaacaacgattcctcttatggtttgagtcagtttttgtgtatcattgttggcgggcttttgcttgttatcttgcgaagaaataataatatgatatccttttatcttatatacatatccggtttccttcaatagttgagtcatagctttgtcgatggctacatttttaagagataaagattgtttcttttctatatccagatttgactgttcataagcaatgctatatcccgtttgtacttctatttgtgcaaaagcctcttttagtgagatacttttattttgtatggtaatttttttttctttattctgtgcaacagttgtgagagagagaaaagtaaaaaataaaaaaatggcaagcttagccgcctgtttattcgtatttattcgattcattattctatatttgtatgttgatacttcattttacgtcacttgttgaatgaggatagacatttcagaactgggaagagggtctcaagctgcttcccggttctttttattcataggctgtttctttttattattgggttaatactattttcttttcatactgctgataatcaaagccgattatatctttcaatatattcagtatttcatccaggctttcatctttcaggaatttgactgtatatcgtttggatgcagggatatttgctgtattatcaatcgtggtgttatagtgtctttccagagttcggaatatttctccggcgctggcattggtaaagaccagttttcccaccatccaagagtttgtatcattcgtatctatcactgatatatggatatctgatgtttttttgtcgtatgtaagttgctcattaggctttagtatatggggaggttgggcatgaatactcacttccaccttaccgctagtcaatgtagtcgttattttttcatcattaggataagctttcacgttgaatctggttccaagcacttttacagaaagttgggaggtttctacaataaaaggacttacagtatcttttttgacagagaaataagcttcaccgttgagaatgacctgacgtttatttttggcaaaagtctccggatataaaatggaacttcccgcattcaaccatacttccgaactgtccggcaaaattagacgcttctgttctccataggcaacagatacctctatcatttcgtttcggggagaaagatagtagaacattcctcctgccaataaaaacaaaggaacaataacggcggcaacacgggcaaatttctgataagaagctacgttggtcagatgctccttattatatccagttcttaagtttacccgttccaatgagacataagtgttcgaatcggcttctacgtccaattcattccaataatccaatgaagcttttgctttcgcctgctgattttggtctttaatgatccacttctgcactttcttttccgtttcggatggaaagcgtgcggagaggaacattttgatgattttactgatattacttttcttcatttttgctgcactttactatatatacagtttagtggcaaaaagctcaataagaaagtggaagtttttttataaagcagaatgaaaaaaaatataatgctataatagtgataccaggaaacatgaaataaccttccgtatttctttcaaagcaagacttagctggctttcaacatttcttttggtagtattcaggcgttcggcaatttcggcattggataatccttcgttacgactcaatgtataaatcattctccgttgttcgggcattcctccgacaagttcgtcaatcagcatttccaattccttggcaataaggtcttcttcggaagtagagctatatcctgtttcttgattattgttcagataggcatcacacacatatttatgtttcagaaagttgattgctgcatttcttgcaatggtgtgcaaataagaattgaatgatctggacgtatcaatcgaatgacggttgatccaaagattgacaaataaatcctctgtcagctcttccgcatcaggttctgattttatatatccgtcaatgaatgttttggttttgttgtagtatgctataaaaatagtctcaaaggccttgtgattcccatcctgaaaggcctccagcgtttttatatcaatgttgttattcatactatctcccaattttcatttcattaggacaaaagaagcaataatttattttagatagatggtcttttttgaaatattaatgatattagaaagatttattctattttcaagattctcttcatctccggacgaaagctatcaccccagatttccagttgctcaatcagaggaatcagcgtctttcccaattcggtgatagcatattccgaatggggaggaagctccatgaatatctttttgctgataatgccgtgcatctccaattctttcagttgttgattgatgacccggggacttgcctcggtaaataaacgatgcagctcgctgggacgtttcggaccagtgcataattcctgaatgatgcaacttttccattttcccccgatcacttccatcgtaatctttatcccacaatcaatatcaaaaggaattttcttcttatacatagttttctgcttttctgcaaaaataaggatatcactacaaaaacaaaaataataaccccaaaatgtagtatagggctaaatttatcagtatatgaataattcgtccctacttgccgatgtttcaggtattccctacttttgcttcaaaaagatgagaaagtatttattatcacttgcattagtcgttggagtcgtttcaatgaatgcacaagaaaaagtaacaaacaatgtaaatatggaaaataaaaaatcaactcttcgttttatctatcctcaatggcaaggaggaattgtagatcattggatgcctgatattccggcggaagattcatccagaggctactatctgggagcacagttattgaactatttagccccacagaccggtcagaatacggtcgaagttccggtttcactggatataaatgacagagcgacggaaaaaggtatcagtgcacgcagtgtcatactgaaacaaactaaagctgcgttcgatctgcttaaagagaatcatccggaccggattgtcactttaggaggagaatgttctgtaagtgttgttccgtttacttatttaatcaatagatacccggatgatgtagctattgtctggatagacgcgcatcccgacatcaatctgccttatgatgaatataagggttatcatgcaatggcactaacagcttgtttgggaatgggagatgaagaaattatggaattacttccgggaaaaacagatgcttccaaagccctgattgtcggactccgctcatgggatgaaggtatgcaggaacgacaaagaaagctgggcattaaaggattatctccgcaggaagtagccaatgatcgtacaaagattatggaatggctgaaaaacaccggagtttcgaaggtggttatacatttcgatatggatgtattggacccggcagagataattgctgccgtaggcattgagcctaacggcatgaagattgaagaagtagttcgtatcattaatgatatatcctccgaatatgatctggtaggacttacagttgccgaacctatgccacgagtggcaatcaaacttagaaatatgctcaatcagttacctctattgaaagattaaatccctctttgacgaggacggtaaagaataccgaatacattcagtagataccccaataaacacaataatggggcaatacgtatgcgtgtcccactaaatatatcgggattataggcggcaagggtactcccctcgccgctcattaatatatatcctatgataatcaatattaagctgataattaagatgacgtaatttcttttgcccaatactgtttttatttcttcttctcttattcttttcgatctcatattctttgagtttagttgtgataattcattagttgagtaaagcgcatatatttcttttcaaattgctgattactctgttcatatctctctttatccatattcttcagtaattcattacactgattccattgccagaacctatacaaacaatcctgttgaaccatccctatccggttatctcccaatgagaaagcccagtcgatataattttccgattctgctatcagatgattcaatagatcggtcgctttctgcgtttctcctatggaagcataagcggtggctatatcatacgaaccgctctcgtatacttcaggaacattatatgccggaatagcttgcccagcatattccaatacttttctggcacggatgtcgtctccttgtttcaccaattctttagccagttgcgcaaagagccttcgatgagaataacagatgcgcagggttgtttcgtccagataaagtccgggagtatccaatcctccgtatttatatctgttcatcacattctcgtagagcttctccgtatctatggcatatccattgccttcttccacgtctccccattctttatagttgaaaggagtaaaccggaatgctaacccttcctgaacaaagtagtcatcaaacttcagtttactggagttgcctaccgagatagccatgtacaggggacgttcccagttacagttagccaggatctcgagcatgagtaagtccactttagtcaacagacgtatattttttagagaaatagacagtttatccggtattgcatctcttagttcttccccttttaaatgacgaatggcttcaggcaacatcattccagaacggagtactgcatccttatcaatataaatatttattgtatcggtaggtatcacatggaattcctgtttctctgcgaacacccaatatttcaggatattctttatttcatacggatcatttccaaaactatcacgggcttcttcgggatgtttctgatacaatgcttctatctgtttcttcaattccggacgaacagccacatattcgttcttcccttcctggtattgattttgatcccaactgatcggcagtccgggagcatcgtacagaggacattgttgctgataaatgtaccagtcggtctgcgcataacttaaattgcagatacgtacatctctgcgtacttcttccgtatcctgattataccacaaggggaacgtatcattatccccgttacagaatatgatcggatttcctttgtcgggaagtgtcatcagataattagcaccaaagtcacgacaggtataccggttgcttcgatcgtggtcatcccaagtctggcttgccatttgtatggggacaaacaggcaaagcagcataagtaagccgactgggaggatttttgcctgtttcctgcgaagcatgtcacagcatccggcggctcccattccaatccagatagcgaacgcataaaacgaacctgcatacgcataatcccgttcacggggttgtccgggagtctgattcagatagagcacaatagccaatcccgtcataaagaaaaggaaaaataagacactgaattgctgcttgcctttttttccacgtgtccattgccaataaataccgagtaatcctaataataatggtaagccatagaacacattgtgacctttgttctcacgcaaagattccggcaaaagtttttgatcccccagtcgcagattatcaagccaggaaattcctgtaatccagttaccatgttccggttcaccgcttccttgaatatcattctgtcgtccgacaaaattccataggaaatagcgccagtacatgtaattgagttggtatgtgataaaataagtcaggttctctttttgtgtaggagcctcattcgcacctccaccggaccatcctttgtaagaagcggccgaacgatcattccacattcgcggaaacaacatattttgagtgtagcacacgtcttccttatagcgaataattttatacttgccttctttcttatccggtcgatagatggcactacctttttctgtctttaccttgtaatagtctccttcgggcacatactccggttcggacgcataggttctcccataaagtaaaggagcactttcatactgttcgcgattcaggtagcttttgagtgtgaaaatagtatccggtgcattctcattgagcggcgtattagcattggcacgaatgagtatgaccgcataggtggtatatcctatggtgagcatgagtaaacaccacaaaccggtattcacgatgcgttttctgaaccgataaatggctcctatcagtaaaaacaggaccaaacccagaaagacgatcaatcctgactggaagggtaatcccatcacattgacaaagaataattcgaaccatcctcctacatcagccattccgggtatataaacaaaaagaatcaatacaataagaataccggataatgcaatggccccgataactcccttgagtgatagagtctgatatttttggtaatagaacactaatacaatggcaggaatacaaagcagattaagcaaatgcactccgattgaaagccctataatataggctatcaggataatccagcggtcaccggacacagaatctgcttcatcctgccagcgaagaatcatccaaaataccaaggctgtgaggaaagaagagaaggcatatacctccccctctaccgcactaaaccagaatgtatcactgaaagtataagctaaagctcccacaaaacctgctcccagaatgataataacatccataacagataatttccgttcatcgcccacaagcaaggctctcactaatcgggtaatactccagaaaagaaacaagatacaaccggcactcaatagtgcatttaaaaagttgaccattcccgacacttgcgaagcatcggaagcaaactgggtaaacaggttgccgacaagcatatagaaaggtgctcccggcggatgccctacctgtaatttttcagcacaagaaataaattcgggacaatcccagaaacttgcggttggttcgatggtcatcccatacacaaatgctgctatcagaaagaccagccacccaccgaaatcattccatcttttaaataataagttgctcattgttctgtacttttttatttgcaaagttacaggacatactgctaaaacaggcattttttaccggacggatacggacggtcgtcaatgataatatgttgataatcaataataataaaagtgaagagatagacaaaaacagacagaggataaattaggtacaaattaataatggcatagtaaagtaaatggcataaaaatgacaatgtatcaaatatgaaaaaactattgggatattaggaaaaacaagtgccactcttgttttttgctatttaatttcgtatctttaataactttcattcttctaaagacagataatcatattacagaatgacaaatatcaccttataaagtgacatttgtcaccctataggatgcccatcgtcccgttataacgggacaactacccgactgcataaaagattactaatttctgtaccaaaaaccattaatctctgcaacgaaaagccttaaatgtagtaaggagataatgaatcattaccagataataattaatttcttgcacaaaatgaaagatcccccaatgatttcacaatatcttccagtgactctttagaatttgccaacatcagtttctccgtttttattctggagattctccgggtcagcgtctctgtagtcagtttcattaaatcagcaaagcaagcaggttggactccctcccgcagaaaagcacatacccttaaatcctcttctgtgagcttcggacctatttctttcaatttagaaacaagtccatagacattctcttgaagtcgcagcaactctgtccagtctttctcggagaaagaagggattttagaagacaaaacattccgttccttaaactgccgtacttttgagacaaccggagaactttcatagatatgtaactgaagagactgatacttctcttcgagatgattacattgcaacatcagcttatccgactcgacatctttcttcagtatttcctctttgaaaagatccagttgggaaagtgcgtgccggtttttcttccagagtagtccaagcaacaaagacatcacaccaaacatacctaaagcagaagacagaatgaccgaagaatcacttttgttatcatttaatatcaactgactggcgtatgcctttctttccatttccaatgcttcatcaaagttaccgtatttctgataataaagactacatcgtttgcatatttttgccagatgatcgtattcctctgtttctttggcaagtttgattgcctccttaaagtggatctctgcatcctctttctgttccaagtcactttctacacaagcgagataataatatactttagatttttgatattcatcaccgtgtttctcataataaaatgccgcctgcctaatctgcttatcagaagaatgaggaatgtttttatcctcgttgagctgggtacacaataaattatactctgccagttgagcctcattcatttggcttgactgaatagtctcaagaataatggacgctgtatcagggtcctgctccatcagttgcgcagccttgtccagcccttgcttcacgctcgtcccttccggatggcaggcagctagtgaaaggagcatcatatacaataaaattcgaagattattcataactctatttttgtctttgcaaaggattgattggatttgcaaatataaaaaataatcggcatttatgcttctataagttacacaaaatatagtgacgctatcctgttcttatagtgacactatccttgctaaatggcgtcactatcctgacaggatagcgtcactatgtttttttgacaaatatcaagccgttgcgggctattaattaagaagataagccgtatctttgtagcaaacaagaaaattatatatcatgattaaaaacattgtatttgattttggaggagtgattgtagatattgatcgtgacaaagcggttcaggcatttatcaaactgggactggcagatgctgatacccggctggataaatatcaccagaccggcatctttcaagaactggaagaaggaaagctaagcgcggatgagtttcggaaacaactgggggatttatgtggccgtccattgacgatggaggaaaccaaacaggcatggctgggctttttcaatgaagtaaatctaaataaactcgattatatattggaattgagaaagtcttatcatgtgtatattctaagtaataccaatccttttgttatgtcgtgggcatgcggtcccgatttctcatcgaagaaaaagccgttgaatgattattgtgacaaactatatttgtcttatcagatcggtcacacaaaacctgcacccgaaattttcgaatttatggtgaatgattgtaatatcattccttccgaaacattatttgtagatgacggcgcttcaaatatccatataggcaaggaactcggatttgaaacgttccaaccgaagaatggtgcggattggcgggaagaaatgactgctatcttggagaaatgataattgagcagttagtaccataccgcaaataagaaatatgcaaccacaagtcatacttatcaccggagcatcttccggattcggtaagattaccgctcaaatgttatcggaacaagggcacatcgtttatggaacaagccggaaaccttccgaagacatgaatcatgtaaaaatgcttgttgtcgatgtaaccaatttcctttccgtttgtcaggccgtagagcggattttatcggagcaggggcggattgacgtattgattaataatgccggaataggtatcggcggcgcattggaacttgccactgaagaagaagtgaatatacaaatgaatacaaacttcttcggtgtagtgaatatgtgtaaagctgttttgccatctatgagaaaggcgcgaaagggcaagattatcaatatcagctctatcggtggtgtaatgggaatcccctatcagggattttattctgcttcgaaatttgcagtggagggatatagcgaagcattggctttagaggtttatccgttccatataaaggtttgtgtagtagaaccgggagatttcaacaccggatttactgataaccggaatatctccgaacagacaagactggatgccgattacggagaaagttttctgaaatcattagagattatagaaaaggaagaacgtaatggatgccatccgcggaagttgggtgctgccatctgtgagatagtggaacgtaccaatcctccttttcggacgaaagtaggtccatggatacaggtattgtttgcgaagagtaaaaaatggttgcctgatgcagtgatgcagtgtgccttacggatattctacgcaattaagtaaacgatacgatatataaaagaaactgttcccaaagttcctaaaagaaaaatcgtccttactacagtctatcgtagtaaggacgattttataagatcaaggcttttttgaacggcctctttttttgatttgaatatcttctatgtttccggattaacctttcggaaccaattccaaaaacatagtagtagtcagcaacacggccagtccgacgcaaacgcttatcaacagccaattgatatatttggctttcggcttggtatctgcatgaagattattcaggaaatactccctaaagaaaagatacaagccggggattgtggcacttgccaacaagaaatcttccggaatctgaaagaaataagttttggataatccgatcagcgaccagtggcaaaggaacaataccaaaaacatattgaccttttgtgcaaacagcaataataatccgatagtaaacaccactaccgaacaaggcatgaccggagaagtcatttccgggaatgagagaccgcgtgccaatgaaaccaaagggtatataaaaggcattgccaacaggacataagacagcaaatcatatttgtgggtacgttcgaaggtagtatatcccgtaatcgcatcccatatccaaatgatagccatcacaccccaaaacatagccattactccattataactacgctcttcacagtagatataatagtagaccagagaaatccacgtatacaggcctatcatatagaacttcatcgccattttcacccacggacgtggtcggccgataagcaatccggtcaatgcaataccaatcagaatgataactatctgtaacagccaggtagctgaattataatatgcaattgttctccaaaaaatctccataaaagttcgttttagtgtcttgttaatgaaaaggctctatgtgggaacaggaacatcgggaacgtagctcctaccgccaacatgaaaatcactgtgcttgctatcagagtattagagaagaacatcgacatgaacttgtccagcttatccggatcattcacattttgcagacacatgataagtgaaaataccatgttgtatgcaaactttcccggaatcatgggaagcaacgccggaatgtacaataccgtcatcgggcaatatacttttttccctaaccacaaactaccgaagccgatgactaatccggcaaacaacgaacctgtggcaatatccacgcctaaataggtcatcaaacaaaaacgacaggcgtgtcccagtgctgccagtatggcaatcattttgaatgcacgcaaaggaggatcggaaattgcaccaaatcctatacctgctactgctgcaaaaaatccatccgtaagaatgtcaagtgctatcatatcaaattaaactattttttaccattaataatgtgaaggaaagtccgatagcgatgctgacaatcaacaaagaagcctctgtcagacgggcaaatcctgttaatacatatccctctactacatcaatcacgccattaatcaaaggcaccccaggtacaagataaagcacgctggttgccatggcaatctccgaagttgtgtcgaaaatcagcgcggtggaagcacacagggaagcaacaaaagccgagactataaatacaacataatgattgatcttttttgcctgcatttgttgtttcaggtagaatcctgtaatggtagccgagaacacaattcccatcgaaattaaatcaccgccgaacaatttgcagaaagacgcattggcaaatcctactagtagtaaaacgaaaagcggatgtatccgcggagcagaaataatcttcttgtatttgtctttcagttcttccaatgacaaatgattgtctactgcttcccagcttaatgcgcttaactctgaattatgttcaaaactgatcgggtgtgcaggaatgtctatgacctcgttacaagcctcgtttgtttctttgtctataatagtcagaatgatgtttctatgaaatacgcttaatttgacatctagtccgaaagcctctccaatacgctttgtgttgcgtaccacccgcgaggtgtgtactccggcccccattaaatgggctgaatattctgcaataaatttacctatggataataaagattcgcctgtcttcatgaatatgatatttttaaatcgggcgcaaaagtacaaaaaaaatagatacctttgccgcgattaaaaataaaaaatgcatgaataaccaatttacgcatcctaaagagagaatacgttttgccatattgacttttttcttcgctcaaggactttgtatggcaagttgggctagccgaatccctgattttaaagacgtttttgctgcaaattatgctttctactggggactgattttatttatgatccctgtcggaaaatttgttgcgatccccttggctggttatcttgtttcgaagttaggaagccggagcatggtacaggtcagtatcctgggatacgcttcatccctgctttgtgtcggactggctcatgaggtctatcttttaggctttctgctcttttgcttcggtgtgtgctggaatttatgtgatatatcattcaatacacaaggcattgaagtggaacgtttgtatggtaaaaccattatggccacttttcatggaggatggagtctgggggcatgtgcaggagcacttatcggcttcgtaatgattttggcaggagtctcccctatctggcattacacactgatatttatcatcatccttataattgcactttccgggcggaaatatttgcaggagagcgcaccgcaggaagcggaagtttctgatacaaagacgcaggaaagaaatacagccaaagctcccaatggttttcgcctgttatttcaaaaaccggaaatgttacttttgcagttaggacttgtcggactgttcgcgctgattgtagaaagcgcaatgttcgactggagtgccgtttatttcgaatcagtggttcacgtacctaaatcattgcaaatcggttttcttgtatttatgattatgatggcaacgggccgcttcctgactaactacgcttatcagctttggggaaagaagaaagtcctgcaactggcgggcagctttatctgtatcggcttttttgtttctgccctgttaggaggagttttcgaatctatggctatgaaagtaatcattaattctttaggtttcatgctggtcggcttgggtatttcctgcattgtgcctactttgtacagcttcgtgggagccaaatcaaaaacaccggtcagtattgcacttaccattctgtcaagcatcagttttataggtttgctgattgctcccctgcttatcggtgccatctcgcaggcgttcgatatccgtatcgcttatatgcttatcggcatattgggcggatgtatcgtattaatagtcagtttcagtagtgctttcgatattcaggaatctggcgataaacctgaataggacaaataaaaaacgcagcctttcacagtgtttaaaattaaacctcctgtgaaaggccgcgtcaatcttttaatgccttaactaacctaactactttatcttaactatactaacctatctacaaaatacccgaaaaatcttttatactactaataatcctatctttcaattcgttattttcaactattgagaagccacagtctacatttgccggagccaataatacagctttagcttcttctgcatctgccatctcttccgggtgctctctgaaataagtttcccattgggaagctgattgcggagttacacccagcacatagttgataaaatcatcatccgtcaaaaaatccattacctttgagcacatatcgcatcctttttaagcgtttacataagtaggacggcgttatcctgtctatgtactcaacccatttacctttttactaaaattaactcgccagactacgcaattttgtcaatccgcgatgcatcaagttgcgtacagactgataattcatattcataatctcgcaaatatcctcgtatttcttttcttctatataatataatgtaagcgcttcacgttggcggggagataattggtcgagcagacgtctaaccaatgaaaattcattcttgcgttgctcttcttccatataatcatcttctacatctgtaggagtggatatgctaacttcttctactgccgtatcagacatatacatacgtctgcgaagttcatcacacaacttattctttaaggagatgaataaataagatctcaaattatcgattgttcctaattcatctttctttgtatagagtttcacgaagatgtcatgaatacaatctttcagtaactctttatcaatggtcaacttcaatccgtaattaaaaaggacgttgatgtgcaagttatacagctgtgaaaaagctgccatgtttcccgcttgaaaagaagcgagcaaagtgtcggttgaatgattagtttgttccatcatagcattaattcgattgatttgatgttgcaaaactaagcagtatcgaccgcaacgttaggtaaaatctggtttgtggattgaaaaaacaagtatcatgttttataacactcttttactagaaattaccaataaaaagcaaaaatcccgctgaatggtcttcaacgggattcctgctttataacttatggaaccaataaataccttctttcttatctggcacttttagattgtataaaccgtttattttcagcgatttatttatcgtttcaatctttccggaagcaggatgaatgtactttaatacatactttccggacgataattgaacaggaatttctgttccggacttggaataaatgatacttccaatatcagattttaccattttcttgtactcatccgtatttgtttcttccacttccattgctactgcatccttcaggaacgctttatctgtacacggaattacaggacatgaacctcctgccatgaatacagcccatcccatagccggataattctgtgcgtagaatgttactgccttttgaggaaatttctgacgatactcattgacagctttatatgcttctgtgaaagttacctttcccactttcatctttcgcatgtgctgacgtggcgccatattttttccgccttccggcgcaaagattccatccgtcttataatgccaataccggatatcaataatatctactacggcagcgcgtttaggatctgcaaggattgcatcctgtacgtctttcgttgtactcaatgccacttttgctttcttcccggtttcagtttcccattcagctatcacgtccaaccaaaattgtacgaagtgcaacgggcctgtaaattcggcgcttgtcaactgaataacattcgaattgtctgcgaagttattcaggcactgacggatatattgtctgtgcaattcacgacgaacaggatgactgatatcatagaacatatccgccacaaagattcgtttgtctccggcaaatggagcaggttcaggaaatccggtctgattgatgttattgctgcttctccatggagaatctacccaatgcgcaccggcttccaatatattgtgctggaaatagttttcatggaacaacagcagtccgtccttatttcctttttctgcaaattcttttaagcggctccagtaccatgcattagggcgtttcaaatcatatttgctcaatccttcccatgctgttccctgaccgctacgaccgaatggctgttcatagaaaggtccccatacatcaccatcccgacggcgaacccgttcgtggtcatcccggcgacgatcgtaccaaagaccataattctgatcgaaaacaagaatgtttttctgtttcataaagtcgactacagaatcaatgcggtcggttaatcccaatccctcgcgtcccggcacaaagcgggtgatggccggacttgccttttttagataattggttttgagctttccgttccaccaaggggtggtatgagtgcctcccaccaatagagcaccgttcatctgaatacgtccattggttacagttacttccggttgggttaataatttagcagcagaagcagcagcagcagcagaagaagaagaagaagaagaatttgcaagcgcagcgctctttttctctttaatatcatcgattgattttactccggttgatgccaccgaaggagcaaacttattatcaccgatccaatgttccaacgtcaaccgtggtttatatgcttctttagcgagttccatagctacttccactgtaggactactggttgcacttgtatttctaggaagaatacgtgcacgttctgcacattctttattcaaccgttctcccaattgagcataaaaaatactgcgaggttgtacatgattgttggactgtgcccattcaccgtcaccggagaattgtgcccaacaaccgtatgcacggttcatcgcatcttttgccggggcataacattcgatttccgctgcggtacattgccaaaacaaactgtttgccgtattccaaccggctccgtttttatcttgtcccaaattcttgaaagtcaggttatgaccgtcgatatttactacgtcaaacaatagtccgcatgcccaggcatcaatagagccactgaatcccaaagattcgtacgaatcacattgtacaaaagcattgggaccggctgcgcaatatccggcagcaaagtcatgaataccctgttccgaatagcagcgttgaaataaagtttgttgtcccagcgtatggaaagtgcaacgacgcatccctccgatttctgaaacgggttctttcgagatacagtcttcaacggtaattttggaacctgtacgctgaacaattacagcacttcctgcaaaatgcttgaaattaaccagtctcacccaacagttttccgcatcctcaatggaaatacctgtccagcaatgatcctcgtctttaggataacgcttgtcgtaatcagaaatcagtgtcatattttctacgccacaatcatgaatacgtccgttccattgataagtcaacagggaagaagttccatagttggcatccaaagctacggtcagcggagcatccagtgttacttggttgccgtttacttcgcagactgttctgtcccaagtcagatccatgtcaccttctttccatcccaaagcactgatacctcctccaaaaatatcacaacccaaagaggcaatccattctttgccggaaggacgggtaaccatgacgcgatctccttttttcagagaaacacccgaagcgacttccaatgttctcgcgtttaccggaacatagtgggaaaacaccttcaatgtgtcttgtacattcaggtcgtccattccttccatgtagataagcgcacctctgtctacgccttttttcagcagtattgttttttctttatccgttccccgcaatacaattccggatgcggagatacgaatactgccggacagggaaaattctccctgatcgagtaatacggctccccgaaaaccggaagcgtcaggagtcagcgaagctacataatcaatggcacgttgaatacgtgcagtattatctccggctttccagggtacaaataccacattacggacagaaggaatatcctgttcggaggatttatatccgcatgtagagaaatcgagaatccggtttccccgatcatcattcaggtaagtgatctggtcattcttaacctgtaaagcaaaggtttgcgcataactttgcacaaacccaatgctcaataatcctaaaaggatcgttcttacttgtatattcattacaataaactttaatctcttttcatccggttacaacagacttttccgtttagacaatgtatcgtaattgttcttcaagtctgtccagtccactttctttctggtgtctatgccattgatgtatttttcaatattggtatatccgtcaccgttgcagtccatgtttgcgtcagccgggtcgttcggattcaatccgttggcaacttcccaagcatccggcataccgtcgccgtccgagtctactaccgcttcacctttatattcgggcagtccgcctacctgacgaatatctgtgatgataccttgtttgtaagaatcagccggtaaccgtctcttcacgtaaggagagacaaactccggtgcatctttcgcataaatggcctttcctgtttgtacggtcttaatgacacgtgcatctactgcgtcacgtttcggaaaattagctcctacattatctaatacaaaggtataagcttttttggtatccattacagttaccggtggcattttgaaagcctcgtccgatttaattagcggcagaaactttgcgacgtccacctcttctttcagttgtacgcctccgtcccagttatcttttgtaactttggcattgccatggataatatttccgtttacgtatgcttttccgaatgaaagcggtctgtttttgtcacgtcctgcttccggtttgagaatacgataagaaatcggtttacctatcggagtgatcggaccgggtttgaaatagttgtttatcatattgtagaaactgttgtgatcgcctccgtctacggaacggttccaccagttgaaaacaacattattgacgaagttaaagtcgccgtccatacctaccgaactgttccggctgatgttggaagcaaagagattacggcagaacatactgttatgcccaccgatggttgcaccgaaagcatgattgtaggtatccaatgcttcagagaaaatagaattctggatggtaatgtttactgtcggaagtttcagcccgtgtccgtctgcccctctgttgtatacatgacggtagatagacatgttttcatccaatccccaactggcggagcaatggtcaatcataatattcccaaccgcattccctcctactgcatcatcacggaaagctacgtcctgcgcaccgcgacggaagcgcatgtggcgaatcacaacatcgtgtgtatcgatcaggaaagattgtccggtgacgcagataccatctccgggagctgtttgtccggcaatcgttacataaggggcacgtacgctaatcgggcttttcaaacgaatcactcccgctacattgaatacaataatacgtgcacctcccgtttcgcaggcttcgcgtaatgttccggggccggaatcttccagcgaagtgactacgatcactttacctccacgaccaccgggagtatacatacctccgccttccgcgccggggaaagccgggatattactttttatcaaatcttcgggtttggaggcccaaggcttatagggacgacctttctttgcttcttctaacactgtcggcaaagctttttcccatgccgcatccgatttccgttcaaactccgcttcttgttttgctcctcttgcttttaccgagtccggaattacaggatactgggctgccacaggtagtacacaggcaaccagcatccacgctgataatactttcttaatgttgttcattctttcgaatcttaattaggtttctaaaaggacgattaagaaagcattttgtaatcggttatctctctcctttccgccattcattcatatattcgcgaggggactgattatattttttccggaaacacttgctataatatcccgaatccttgaatccgacagcaaaagcaatttcggaaacacttaaatccgtatttttaatcagttcgatagatttattcaaacgaatctcttttaccaggtcaacgggtgccaggccggtaagactcttcagtttcttgaagaatgccgaacggctcaatccgataccggatgctatggtgtcaatgttaaagtcactatcgtccatattttcttcaatgacctgatgtatcttttcgaggaactgtacgtctttctttaccaaaaattgttcgtagctgtcttcttcggtcgttgtctggttttccatttgctgacggattcgttcacggaacagtttccgttcggcaagcaactggtcaatacgtgccaacagatattccttactgaaaggtttggtaatgtaggcgttcgcccctaaagtgatcgctttggtcttggcgccttcatcattcttcgcagtcaggataatgacagggatatgactgatttggaaatctttgcggatggattgcaacatttcaagcccatccatttcgggcatcatctgatcggtcaccacaatatccggatgatacagatgtactttcttcaaaccttccactccgttattggcaatatggatattgaacttgtcttccagctgaagctttatcaactggcaaaggtctttgttatcttccaccaacagaagggtcggtaatgaagcgtcgatttccggttcttcttccgtaccgtcttcggatatggcatttgcaacaggatcttgttctaccgaaacaggggctgtctctgtatctcccacatagaagtctacttccgacgggcggtaatgttccttatccatcagaagttccacaataaacaccgccccttgtccttcgggactttcagcacgaatctgtccgtgatgcagattgacgatctcttttgaaagtgccaatccgatacccgtgccctgataataggagttttttgcgttctctccttgcgagaagcgttcgaaaatctcggtcagtttattttgtggaatacctactccgttatcttccacccgtacataacaacgtttaccgtcgtctgtcaatccggtagttatataaatacttcctccggaatgagtgaatttgaatgcgttggatatgatgttgcggataacaatgctcattttttccttgtccgcccataccataatcggttcatccggcaactggaaagtaaaactgatttcgttttcttcggaaagtacccggaattctttctggaaagaagctatcatctcattaaaatcaattaatgacacatgcaaacgcatcttgccgttctgaatcttccggaaatcaaggatctgattcactaattgcagcatttgattggtattcttctccatcagatccacatattgcaatcctttcggagagagtttttcgcgttctcttagttcctgtatcggaccttttatcaatgtcaaaggagtgcgcaattcatgggagatattggtaaagaacttgattttcatctccgatactttctgctcgatataaatatcattcttcattttgagcatgaagaaagccaggcgcaggctgaaatagagagctgccaaacctagaattacataaataagggttgcccaccagctcaaccaccacggtggaaggatagtaatagccagtgtacagttggaaaccagctccggattggcttcatctacggtttctacacggaatgtatagtctccgggaggtacgttggtataagaagcgatacggttctttccgttataatgccattctttttcatatccttcgagtatatatcggtaagatacccggttctgattatagaaattcaatgcggcaaattcaatcgtgaacatggattgattgtagttcagttcgattgctttggcgtatgtgatggattctttcaggatcggacattcgcggaaactacgcagatcgcggttggaaactttaaagtcaacaatacgtgtatcgtagttcgtatgcaatgtttccagtttgtcgggagagaatgtcaggattccctgccgggtaccaatccacaaatctccattcaaggtacggagggcactcccctcttccaattccacattcaggaaaccgtcgtatttgtcgtagttacgaaactgttcggtagctttattgaagcaagacaagccaatttccgttgtaaaccacaagttaccgtttttatcttctacgatggacttgactacatcgttattcattccttcacgtatgccgtatgatttgaaaatcggctcacgcttttctttatcatagcggactaatctattcaaaccgcctccgaatacacttacccagatttgcgaatcagtatctttgtagagtacataaatatcattatccgctacgtttgaattttcgctgacctggcggtacgtttcaaactggatctgttcggggacagtgaaatgtccgtcgaaagacatcaggccatccattgttcctacccaaatacgtccgtcttcatcttccgtcatggtacgcacctccatataaagaccgtatgcaggatattgtttcaagccattgtatttatggataaaggtaattgctccgttctcttcggaaattagattcagacctcctcccagtaatcctacccaaatgcgtccctggctgtcctgataggtaaagtacacatcgttgttactgatagaattcggattcttggggtcattgatataacgggtaaaacgcaacccgtgcggtgaattcatgtccggttcggctttaacaagcccgtttcccttggtggaaaaccaaagattaccgtctttgtcttccataatatgatatacggctcccaacagatagttcttatccgagaagatttgtttcacttgtccgttacgatccaggcgatacaaggcttgccagcgggttcctacccaaatatccccattttgcgcctggaagagagcacgtattccctgattccaggaagtcgatctttcgggcactaccggagatggagaaacttctgtcagcagttggaattgcttcttggggaaattaagcctatatactccgctgctcgtagatgccagccaaaggataccatctttatccagcagaagatggaagaaaagctgattgggaagatcgtcggagaaaggcttcaattggttgatacgggtcatttccagtttctccctatcgaatagaagaatttcccctcccggagtcataaagaacatgccctgttcgccggcatcctgcatttcaaaattgccgattgcgttctgattggggaatgtaaagcggtggtggctcctgttcaggggatcataataagtcaatgcctggttgccttcctgaaaccataccttatcgtatttatcatagaatataattccattgtctttttcggggatggtaaaggggagtttggtcaactgcttgtagccgatattgtactcgtatgctccttcgttggtggtaatgtacatcaaaccggattccgttaccagcaaattagaaaccggctgtttgatttccggtatctcgtaacggttgacaactccgttttgcggatcaatgctataaatgtggcctttcttgtctcccaaccataagaatttggagttataggaggcacaagtaaactgatcggggttagcagatacctttttctgtataaagtcggcaggtttgtctttcagcgcttcccctttccgtagggacagaatctgataatccataccgatccaattgataaactcggctgtttcgcagaatatgttgtgtttcagacgcatgtcgtacacgtttacgttaggacgcgaatcatgcaattgtttcatcgttattttaccttccttgtcggtgtacgcacgcaaaaggcttttatcttttgtcagcaacaatacgtcgccgtcttcggtcgtctgaatcttgataatctgaatgttctcggaatattctttcacatcatcgtagacggcatgaaagctctcatgccgtttatcgaacagatagagtttacggtcgatagtcttaatccacagaaaaccattcttatcttctacgatgcgctgaattttacgcggcggaatgtctgtggaataaaagccgtcatgattatcgtaggaacggaatttacttccgtcaaagctgcatagtccataccaggtaccgaaccagataaatccgtcttgtccttttaatgtacagtttacgatattattaggcaaaccacgttcagccgtgtagtgttctacaatcatatttggataggcaaaagcatacatgcctatcatggatagtaatagtattagaatattccgttttctcattgatggctataattggaattaaacgtactcaaagatagtctttttttttgaatagtgctttagtaacatataaaaaacaagttggcagattaccctgctaatcacttattactaacctgctaatcacttttatcgtactatttttcagttccaaattcagtctgttgacgttctacttcatccaacacccgttggcgttcttcctctgtcagttgtacttttccttcagatgatcccttgaccgggggtgcattaagagtggacggtgttgtcctttgtatttcataagcctgttcctcatagcagaaaggaagttctgcaggaacactttccagttcaatttcagtagctgtcggagcttgagtgccctcaaactgtacgcgggctttcacctttatttttccggctttccgggtagaacgaatcaacaccggagcagagccgaactccaccgcacggggattagcgccaatagtagcatctccgatgatttctccttcaccttctaccgtgaaaacgatattctcttttgccagacggcgcacatttccactatcatcggttacttcagcaactacgacgataaagtcagagccgtcagctaccaggttcacttttggggtatctatgtaaaggcgtagtttggtggaacgtcgggaaggcattttcttttgagtgcatactacttttccgtcgatgattccttcggcaaccatgtttactttttgccagttcttttgagtatagctatatccgcgtgcttcccaaaagtcccagacattctcgaatataacgggagtattcggcatgtgccctttggcatgaactaccggtttcgtccaggttttcgttccatcataaatagaaagacggactgaatcacagtttgtaaatacaactacgtccttatcggagaattgtgacatttcatgagcaatgaatatcatcgggccacattctgccaatgggtgttggagactggccggcgactggctgcgaaatacttcatacgcatattttttctgacggaaagcatcataaatgccgccccaataagggtccggatgatagccacgctgatggtcgaacggatgccattgggcaccaccgataaacaaaccggttgtgcggtacatctcgtcatagctctttgctaaagacatagcctgtaccagtaacggacgttctccccaactgcggctggcacggttattattgttgtgagcataccagtcgtctacattctccccgaattcacgggtaaagatacattgctccggcttgtcttctttttcatcatcacccggccagccataaacaacgtcataatgctctttcactccggcagaatggacatcggcagcagctaccggacgtcccggatagggatattcttctttggtaatctcaagagctttcaaggcaaaatcgagcggatagcgggtttcattcaagatgggttcccacatcaatacggaagggtgattacggtcacgacgaatcatttcgcgggtattctgatgaaccaactccccgaatttcgggtctttgttccagtactgccatcccggagtagcgacaatcacaaacaggccgagctcgtcacaggcatccataaaggcagggtcttggggatagtgggctacacgaataatggtgcatccggcatcacgcagacgtttggcgtcacgccattgctgtgagttcggcaaagcattgcctacgtatgcaaaatcctgatggcgattggctcctaccagttgtccgaaaggtttgccattcagccagaatccgtctttaccacggaattctgccagacgaataccgacacgggtaatgcctccgtcaatggatttatttccttttttaatgcgtgattgtactctatataaataaggagtgtccggagaccaaagagtaggattctttacttccatctgttgacggatggatttcttctctcccggctttaaagaaagttttcctgaactgcgtttgattacttttccatccgcgtctgtcaaagtcgtttctacagtgactgactcgaaacgggcgtcgtcattctgaacttcggtgtttacatatacctgcgcactcttttcactgatcttatcaaaatgaacgaatacacctccaccgccaacggtttgtgaatcgatagcgtcagtaatagctaccggagatttggcaatcatccatacatcacgataaatgccaccatgataagcaaagtctaatgtgtattgacgttttccaggaggataggatttgtcatcactgttgtccgtgaaaacagcgagcagacaggagtctccagcctgtacaccattggcagtcaagtctaaagtaaaaggtagataacctcccagatgttcctggatgcgtttaccattcagataaaggatctgtttgcccatagctgcttcaaaatgaagcactacccgttgcccttttgtttcagcggggaggacaaagtgcttacgataccaggccggtccctgataattgcggcatccgcttccttcggccggcatcaactctacagtatgaggggtggaaacgacattccaggaacggtcatcaaagtttaccgcttctgctccccggacatcgcctctgaaaaaacgccatcccggattgaaattatagacttgtcgcccgctaccgggaagctgaatgaatccggcaaccgatgtctcgggacggtaagtttctgcagcctgccctttttctatcaaagagaacagcaatagaaaagctgataagatgataaatggtcttttattcataattctttatttatatatttcattcgttaaatgggaatttatcggttaaatgggaattttgcagttaggctgaaagccttacaattatatatttattgggatgccctttctgggcgcaaattcagattgtcgcttttacgtagggcgttgccctacgctatataattaagccctttcagggcactccgcaaaattatcatttttccttttcaatcattataacaatatccttttctctactttccggtaaaactttcaagtccgtcacttttccgtttttcagagtggcttctactgttgtttcgcccggagcatgaagtttgaaatgtacgttccattctttcggccatgccgggaaaaggagtatttgttctccatttgtttgcaatagcatttcctgaagtcctatcatgccgctacctccccagttgtgatcgggtgtccagtcatatcccggtccccaaaatgcggggaaacgatgcggtccattcgataatttggctaaagatagtttctttgcttcttcggtcaggcctaaacaggcagcccatatattatcttgtttccatccggtatgcgaacggaacttgatggcatccgggtcataaaagtaggtattacgggctatatccagatcctcctttcctactccataaatacgccatggaaacactggataaagttgtggcgtttcaacattattaattcgttcccaacttacagcgggcgaaattgtttgcttcaagaccggagcaatagtcggattcaacgtatcttttatttctatgtaccgcaatggaatcggagggattgtctttagcatctcttccttctttccataagtttccaatactgtttttagagcagcgatggtgctactggcattattagtcatcttatatgtctcacaagcagagcccgggaaaagaatcagatgtccgttgccatccaacgctttccgtccccggcgggaagctagttgccggtaatgttcgtcgaagaatgtcagcgaactctcgatcagaggtaaataaggggtaatatcagcatttgcatagttctttgtttccaatatcatttggcagaactcaagaaccgtatcccattcatattccagccaggcattatattccaatcctttgtcaaaccagtccggtcgtttgaaaccatattctgcggggttcggcaaaccgaaattttcgatctgctcgctaaagcaggctccatcatgttgccaatatacacggcttcgcagttctgcatttttcaacatgtggttataaaaatcaaactgggaaggcatcatatcaaagtctccgcttttcagcatcggccagtatactaaacgttgattctgtgcagtcatcgtaccacctccccatttccggtagtcaggggtaaaagattgtttttcatcgacatggcaaggatcaaaggtaaatagtccaccattgaatttagtcggtacgctgccataagcattacatcccagcatataacggaaaagggtgtagtttctagttatttctttggcttcaccatctgcttcgataaaactgcgttgccaaaaggaattccaccacgaacgggtctgttttttatcctgtatgatagtcttcgatgaaactttgcctttgggggctattctatgcaaagctatttgtattccctgctcccactcttctattgtctctgtctggtctgtatgtaacacaatgcagaaatgttctttccgagctgctttggaagaacggaacttccaggcacgatagtctgttccggcatatacatcatccgcagtgcctgcaaattctaagttttcaccaaaaagagttcctccgaaagttaagtttttcagaggattcatcatttgagattttacttcgttcattccttgttgagcgacaactacatcaaaaacggtctgttcgggattgcgatgatagaacagaagttgatttgtatttacggaaacacagtcggactccgtcacagtacctttcgggggagcccatttgtaggaacactgttgcccctctccttttctgacaggccgttcctgatagcgccaattttcataaaagacttcagtctgcaacggttgtgcatttgttacctctacatgtataatcggatgaaaaacatctacccaaaattgtatctgcgtgtttcccgccgcgatttctacatatccgtctttcagcttcaactcctgacgaaaatctttagcgtctttgaaaggattgggcgacaggcggagacgtacacgcccttgctttaactggcagttgttttcgtcgaatgtaccgctacggctcacatagaacataacatcaccgtcttctacccatatattcatcccaatatctccaccgccacagggcatagattcagaagaattacgactgggagtattccaaatgacattggcatgctgactccaaagagccgacacgccaacaaacagtatggttataatcagataaaatctcttcatatatttttcatattttaccttgtctatttgctattaccaatcatccgaacgaaaagaccctaaaggcaatccgtcgcaatatacatctccttccacatagttttcaaaacaatatcgaacagctaccgggtgcggtactttatcgcttttcaccagcatcttactacgttctatccatgctttggccggataaaaaactttatcttcgccggctacctgaaagtttttcgattcgaaacagttcttgccgctgatccacatattggcacgttcgaagctgacaactacggtgtcgttctttatttcaatgcttttataataaggactttcgccatttacaccttccactccatacgttttagttaaagccagaagagccagacgttcgcctgcaatctgtttctttgcgggatgaatacctttttccattcctgcatccagtaatacagccataccgctgttagctacacgatgttcaacttttgcctgtgcctcccggagatatgccgaatttatcacttcctttcctttttcggtaataatcccgtaatcatacggagctatctggcaataataaaagggaaaatcaccctgtttccattcggcacgccaaccgttaatcaatcgggtaaacatatcagcatacgtatgggcacgattccagttatcttcgccctgataccaaatcactcctttcattgtcataccgattaacggatgcaacataccgttataaagcacggtcggagtacggtttttagattttatgtcggcttccgtttgaggaatcttcgcttccgggaaggctttcagccagtccgctgtcatccatgcttcacaggcggaaccaccccaggctgctacaaccaacccaaccggaacatctaatatttcatttaccagtctcccgaaataataggctgttgcgctgaaatcacggacactggccggggttgcttctttccacgaaccgataacgtcattctgcggagtgaatgtagaagtacgtttcaccgtaaacagacggatttgcggattcttgctgtgaagaatgtccatattggcattttctaccggttggtttttgaagcctttcatcggcatttccatattactttgtccagaacaaagccaaagctcgcctatcagaatattattcagtgtcttttgggttccatcatcaaaagtcacagtataagggcctcccgcttcgggagtagctactgtcagtttccatgccccatttttatctgctgttgctgcatattgttttccattccaactagtagtcactgttacttttttatgaggagtcgccgtcccccaaaggtttgcattggtctgttgctgcatcatcatgccatcagaaaaaatagccggtagctttacttctgcgtgtgttgacaggcaggcagcaagcagaaaacctgccaacattgtacctgttttaataattgaacttttcatactttagctatattataatgaattgggcacggattacatggattgcgctgttactttatgtaatacgattctcataaaccgtgtaatccgcgtaatccgtgccttaaaaatctattttattctgtgatagaaaaactcaaaggtccgagtaatcctgccggaagcaacgttttctctgccctgcgatattttgcattagtccaaatgccatcaaacggcgcttttccttcatcaactcctgtcagtgcattcgcccaagtatttgtaacctctatttcaagctcattagttccttttttcagggcacctgtaatatttgcacgataaggagcagtccagattgtgccacaatctacgccattcacacgaacagttgccaaattataaactgttcccagattcagataaatctgttggtctttattcggtttatttttccagcggaaagtggtcttataagtcgctgtccccgaatagtaacgtatctgttcgtccgattcttggctccagtcgaagagttcttgtcgtgtgagcgtttttctgttagctgcaaaagttatagtatattcctttgcttccaaagctatgtttaaagaggctctggcgatatcttttttctccttttgcagttggagagaggactctccatagccttcatgtactccctccgcaggatatacgatgaatacggactcattaggagccaatgtgagagtaacttctgtccggtttccgttgatacgataggaaggatgaatattcatctcacccgtcaccggattccaacattccggtttcttaccgttaatacgcatacttgcagtaaacgtgcgtgtttcgtccttttggttggctacgaaatagagttcgccaagttcgccacgacgatgcgtccaggcaatatcttccggcacgatcatgtcacgttccaagccatacacggaaaaatcttcttctgtataaggtaaagaaggtacaaaaatgccagcttcttttagttcattgattttcttctgcacttccgatgacaatacaggttcgggattcattggacgcgcaagaggcagtatcaacactttataacttgctccacccggcaacgttattcgtccgttttcggctttcgccaaacgaagtaatgcatctttattaaaactatcgtatgcatatccacgaagcggattcacccatttctccggatcagccatgttagctgaatgagtaacacctaccggacgtacacgtaaaggctgtccctcattagccagacggatgcgttcactttccactcgttctgcaccgaagattcccggtagagagggaaccaatcgttccggtaatatcgaacgcctcggcacttcttcgcctgtaaagactgcgatgtctgttaccggatgcccatattgcaataacgactggcaacgggtagcatattcggaaaaggcttttgcgcctttatcccaccaggtctgatcccgttggaagaatagtccgatgccatccaatgtcatgccgggcttgcggtccagccagggattatgtacatatacatggtagaaaagacgattgattcctaatgcgtaattacgatccaacaaggctttcaacattccggggtattcatcccacgtgccacgcacttccgtgaacccttcagcctgaataatattctttccgtagatatgtgctccgctaatagcgtcgagcatatcattcggtttgtcatgtgtaggactgttcaaccaaaattcacccatcggaagatctactttttgataatgtaatagaccatcgcttaccatcgtcggagctacacattctgccgaaaactggcaatcatattctctcgcacagtccgccaatacctgataaaacacatctacgacgagttctgatatggtagtacgtacgtctcgcagaatcttttcactttgttcgacactttccatcggaatacctgccaatagaggtagataaggcatcaaatcgtagccacgacgtttctgaaattcaatagcgaaacgtttattccagttttggctgccacattcccaactgtcgacatgcatatatttcagtacgcgacgagctacttcgggattggtctttgcaaatgcctgcgcaaaccagttatcgaattgcttctgtaccgtttttgggttaaacttatcacattccaatccttttccgcctcccgctgtggcattggtatgtccggtagctgtatgtcccatgcggagtaatttccattttcctttggggagagtggcggtcaatgtttttccattcgaatgactagtatattgctctgtcagattgatgacttgtgaaagtgaatagcagtcctgtttcccaacttcctcttctttggtagcttgagcaacacgccataccagtccggcttttccttcccactggttcagacgggcttcccgatgcaggcgtaattcttttattttcagattgggcttccatttggcagcatccatatcttcacttcccggttcgcttccttcaggagtccagtagaaacggaagaaacgggcggtagtcggaggaatactatgagttgaattctcatccgtattctgccatccctgacgggcaggaaccaactgcttaaccaaacgataattcactccgtcatcactggccattactttcaagcggtgtgcctgataattattaccatttaaaacgatttcaatattccgacaagtgaagggttgttcgtattcatactggatataacaaggatacgaagaacggatcactcctgccgcatccatattcactgtttgagcagcttttacatttcctgttgtggctagattgacacaggtaatttttgcctgcatttcgtccgctgcgccttctaccggcaaagcgaataatgcgatgtcttcatagtagttttcataagcctccggttgtggcaagcggatagccatcagcttgcctccgtttacaatcgtatcgctccaaaccactttctgcatagattcttcgggagtaatccagggacctcccgccaatgcgaaaccatcacaaatgtgcattcccaatttcagccccaaacgatctgattcttccatactgaaacgtaccatctcccaccattcgggagttagctgctgcgccttgccatcgtattgggcgccttcgtggatacctttaatcggcatcaggtaagtacctcccaatccggcatgtttcattgcctccaaatcggctgtaatgccttctttagacacggcaccatacatccaataccaaaaggtccagggttttgcttcatcggaagggtttagaaattgatcgcgaagtgagcgtgtttgctgtgcatcggcagggcatacggctgtccatgctaatagagaaagtgcaaatattcgttgtttcagtcgatttttcattccaatctatatttttacaataaaaaagacgaaaatcactctgttttgtactcactattagcttatgagatcaggaatataacaactttaatcaaaaaaaggtgcacctcctttcctactctcggaagaaggtgcaccacacaaacaaaacaaacaatagacgaccttcacaggcagtatttcgtatattacttaactaactataaatcatgatccatctatctgaataaaaattctttctctataatcagacggtgtcatgccggtatgttcgcgaaagaaccttgtcataacggaattcgactggaagtttgtacgtgatgccacttcttttatttcaaggtccgaatcccgtagaagagcctttatctcaagaatggaatattctataatccagtcttttgccgaacggccgctcatatccgtaattaccattgtaaggtgtttagcggacacgcacatcttttgtgcataaaacgcaacatcccggcttacggtatgaaattcgatcaccaaacaaaagaagtcgaataaaagtttttccttacgggtatattttactaattcggcagctttcggatttcttttataagccacatagatatcccaatagaaaacacgtaaaagttgcataatagactcccgtctgaataagttccgaggcaagttgatacgataaatcagtatatgacaaaagtgaatgaagcgttgacattcttcattgcatagcggagtgctgaaatttttccgcatataaaagaaaaaatcaagagtaggtatacatactccgcttatcgtatccataaacaagtttttggatactttgagaaaagtcattgaaaagtcatcgctaatctctgtgacagcagccaactggaaaggaaaaataacaaccagatcattgggaacaatccgtcgtttattaccaaaaacattgaaaagcgcactgcctcccgtacatatcccgtttatcccttcttcaagatacgcaggagtttcattaagcggtaaatcgtctattttagtatagacattaaactcttctgtttctgatatattatcaaatactttattttgcctatatggcttattatctttcattgactgcaatttatgctattatgctgtttgtctttatttcttgcttctatatatacatatgttaatcgtgacattttgattaagtaaattgtacaatcaaagatatgggaaagatatataagaaactttctttatctttcatcagaatcatcagtgccagaaaatattcaccttcatcaatatcaggaatggttgtatacactttatcgtccgaatatttatgaatatcaccacattctatcaacattctgtcatttactgaagacacaaggtatagattggcgctatcccatgttaacatatccaagtgatgtccagtgatgacaatgggggcttgtggtgtaatcctcccattacattttttacttgaaggatcatatactttttcaatggcagggaatggtgctccttcaatcattaatatttcggcttttatcgttttcattttgtatgataataagtgtgtatataaactgatgatgattttgttcgtaactcattttaatggaatatcccggatacagcggagataataagacttcttctgtttatcgtaatagcctgtatttagcccatatcctgttatttgattatcaggatagaatcgcattgaccatacatcttttgaatctcctcctttctctgttgcagaccaataataagtggcccctattgtggaaagagcgaatggctgaaaaccggttgttgccttagtctcctccatttttttataaaaaagtaaaatcaatgcacactccccacgcgtaggtacccgccaggttcccggttcatccagcccctctttcccacgatatgcggcacatcccttggcaactgcaaaactaggagtcgaataaatattggtattggcagcagtaagatatccgtttgccgtagcccaatccattgtttgtgcacctgcctctccttcgctatttacaatatcaggcgaaacgataaaataaccggataccttccagtcacatcctccttctgtttgcctctctgtatgccgtgtcgttcggtatacatagacatcattgccgctttcatctttttcagcttcggtcagactacccgaaatgtatttatacaactgaatatagctacgaaagttggtgtttttgctccggtcctccatcttgtatttcaccattccttcataattgattgccgcatatttattcccttttgaatccgcatatatctctgtcgattgagaatatacttttagtggaataaaaaataatatataaaattttatgactgttaatctaaatatattcatacttcttttcaatttatattgttaaattcttatgttcaatatggaacataagaaggaagagacacattcctgacacatctatctgatccggtagttctgtctgaattcccaaacttaccatcggaagcacttatgaaataataataattatagggtggtagtgatatatactctgttgtcgagcctccacctccaagtcccggtagagcagctacacaaagccctaataactggtttgacgcaggaagataccatttgaattctttttcatcaattatcccgttcccgttttcgtctctgtttctgtcataacacgcccttgcgctaaaagtactggcagggtattgatattgatataataacacatgttcggacgcatctttctgtggaatcgggacataggcgtcaacccaattttgattgtaagtattttccgctaaatgccgggttgccgttttaccattatccatattgtctgttgcataggatagttctgccgttttgatattcgcatagccagttctcgtcgttcccggctttacatctgccaataaactagatgtagttcgtaaagacattctagtgtatactaaccccatagtgtagtttccatccccgtctttctctcctcctaaacgtccaaggtaaattgccgcccgctggtctaaacggaatgtatgtgaagtttgtagtgcttctcccgcatcgccattagttgtagtagttattttaatatatagggatcgttttcctcccgtagcatctgcaccgggatcaagcaagttccccttcccgtcatcaatatattcatcattatatagataaaacttcaattgagtaggaagtatggtgctggccttgatatatgtatccagaggttctttagtattattatacgcatctgtgtaattggaagaagaagacaggcggagccaactctgtgtgggatgttgggtacagctttcatcagtatatacacccacttccaccatccgtccttgagtctggataactatcggccggacctcataagctgcatccagatcatatttttcactagaagcattgtatttagtatcgaatttgcctccaatgacgcttacgttcttactggcgtgaaactccacatactggctagcagagtatgtcctgattcgttcgtcgtttttcgccgaatttatgtctgtattaatagttgtgcgcaaattataaaaatggttgggttccacatcgaagttattagtattattactaccaatatacatttggtaaatcgcatatttgcctgttgccgatgttgaggtagaatacgcccatgcctctatctgcatacccagtaccggtgcactacccgatgataccccattgaccactttgtagtagcgttggttttcacttgctatgcttgctaccgtcccttgacaattctgcgcaatataccacgttaccgaatagaagccattgggatcggggtcaccaaatttatctatctcaagcgtgacataagtatccgtatcggtattcttttcgggattggtaagccgcactgtactattgacattcagcaatttcagaccctgcaatttgtaattttccacttcgagtttatagcggaatgtaatacgtgccattagcttcctgatttcaatgcctcccacaaagccggcaggtttgttatattctaccaaaccacggttacctccgtcgatgtttacaacagtaacaccagacacttccccggcaaaaggcacttcatcttcagcggtaataagtgactccgtatgtccttctacattagtcagatattcaaagccccaatttttaaggtcattaagagttttcactccactcatgtcataatcaaatttaggtcccagtaccaacagaaataaagtctgcttctctgctactacaagggggacatctattgtcaccatatcattaatagccgttgccgtatcgctcaacttatggggatttccattaatggaaccattctcattgaactggaaaagccagagattgtgcaactttgttgtgccatcggatactctggtcgctgccgtacgttgttcttgttccaatacgaccgtgaaggatgaatcagagttattttcatttttaaagaacggctttacagtaggatatctacctgttggtgttgtttcttcaataggcggaagactgacattcaaactgaccataaccacttttcccgtagcatttcccggaccgaactcattcaggtcgtcttttgtacaacctgtaaatgccagtgaaaacaaagcaatgcaaactgtcctgatacactttttataattggtttttattctcatatcatatctgtttatcatcatattattcatccttgttcttatttggtaccattctgattaatagacagactactaagagtaatatctgctccggcatttctcattaaaatgatataagccgtgaggccgatgagactcggactttcgtttgctgggattgttattgagataggatagctatacgtattcgatacagtctccactttatcactgatacttatttgtccaccgttgtaaacaacttgtacatataattttcccgcaggtatggggacgtccgtagggctaagattgatatttagatcataagtgcctcccttttgaggtaaaacgcccatagtacttaattcagaactggcacgtaattgatacccggcttgcgcaattgtgagtagtgtactctttgtctgtccgtccagtccggtaccttccacccttaccctaaacgaacgggatgaagtactttctttacgtttgacgtatacatgaatattttgggtattgctaccgtgtgtcgtatgtacggtattgtccccaagctcaaatgagaaatcttcgggagttgccgttcccatatccgatcctgatgtcacaagtgtagccgtccaataaggaatattcgaactaataccaaaataagagtttccactggcttcggtcccctgatatgagggagaaacaataattcctactcctatccgactttccggtatctcgttgcggacgcaacgaaccatatatccgttttgtctgtccttaccggattgaaggcttgcagtcaccatcggagtacctgaaaaatcaaatatagaggcattattagcccagtagcatccggtagtaccgtttccacacgacacaccggattcgtctctgtatcggttgtgaggcaatagcagccagtggtacgaaaagtatccgtatgaacttgtttcattatttgatgccgctattatatgattgtattcttcaggggtagccatgtgccactgcccgttgtctatgattcccatatctctgatttgagtttcggaaagaccggcaagtttgcatggatctcccaagccctgtttaacctgttcagaggtgttatctgtggatatttcaccgtccgtcaggtaagggacatcactccatcttttgataattaagggattgtataaactgggataccagagtatatcgttcaatgtttcggcatcggcaggtggagcgaaatttgcgccatcttcagtagtcggagcactgtgtacagctatcagactgccgtatttaaacaatacatccttgtatcccgtttcagaatgatatgctttcagtatccctgaataaacactaaagtcattccatatattcacatttctggacgtatcggctacggcgtcatagtctgcagccttgtcacttacaataaccagtccgtcaataggtttccagttgatagtgatgtcatgttcctccattgccactatttccgcataaagtcccattgctcccatgccggtaatggtggcgtatatccgataatggttgtttcgtgtcaggttatgatttttaggaggctcttgaccgatattcagcagatagatgcagttcagcacctgtgtgctgccgtttttaagaacgcattgtgcatctattttaagataggttgcttgtgaagcattttgagggtcggacaatatgtgttcgggaatataagtagtaggaatcgttatgaaatctatgttatcaggaatggtgtagttatttccatttatcgtatacgtaccgttattatcgagctcgcctgttcctgatatagtaagatcatccgaccatacattttccgaatatgcctgcccctctcctatagtagtggcaaccggcattcgacacacttttacattcagtctggttactttaaaatcttcatcctcattggtgatatttttaattgccgtaaagctgatgcgggacaccatacggtttacctcaatcggcagttccgttgtcgtaacattattgatggtaactgtggcatttgttccgtcgctacgagactccacataggcacgtgacacatttccatacataggtggcggagcaacaatacctatagcagagaatgtcactttttctatttcattttccaatgtaatggcggcgagcttttccgtaagctccggtgtttcgttacagatgatgtaaatgttgttatatccccgtgccgctcttatgggagcgatatatatgttatctacgtttatggaagcatcagaaacgtcgttgtataccaattcgtttttgtcgttaaacacaattgcgcgtacggattttatgacttcatcatcgtcagcagtagtattgcgtgtccccattttaatactcattggtatcttttctccttcgtaaatacgtgcgcctgttgtttcgttctcctttgtacaagagtaagcaaacaaagcaaatattgtcaaaagcaggacatttgccgaaaattgtatgttgatagttatattcatccttaattgtgccataatttcgtttcaaaaaacggcttacatatctgttggttggaaccagtaggtccagttgttaatagtgatacttaatgctacataaccgttctcttccttatctccgatgcggatgttaatgtcccactgatatctgcggtcgagatattcctggtcacccatcgcttccggtttacttttcagcaagtagtcaataagatttatggttgtttctcctccaatgtctattgcttttcctgatgtttgctccgtaatggaaaaaggcatagcgacatctttgacgaatctaagcgtgtggagccgggtctgaagagatagtttgttgtcttcctcatccgcacaagggtggtaaattatgttcttgtttccatctccaaaattatttttatagtcataaatactgtttgccgctatcaattgtatatcgtattttgaaagatcgaccggattgctgcctcgtgtaatgcctatcgttatatcattagtattacgtatcaggttgacagtttctgtattgcttatgttctccggagaaaacatttgcagcggaccgctataccataatgcatcaagatgattgttgctcatgtcattatcgggctcgtattttaaggctagtttgtctatcggatcacctgcggtcattgatgatagccggtaaaactcatctgtttttccggcccatacaacagccgtacagcctttcagtcgataagggatcagcatacgatagtccgtatttttcagcggattacctttttcgatgaatgtctgaagatatttcccttctgcatcgaacacatagacttttacttcctccacctgatcggcaaaccagtcttcatttaccatgttatagtcatacctgaattcaagaaaaaggtcacactggtcgagatcgtcatgaaagacgtcgcaaccggtaatccctgccgccataaaagcggcaaggattattatgtatttctttatgtgtctcttgattttcatctattaatgcaaatcaacaccttgtgtccagtaagtccatggattgatagtgatttttacagaaatgtatgcgtctgcttcatcatcatcggtacccggaggtgtaggattagtaggatcaggatcagacgggtcgggaatccacggtgttccgggaccgctcacgctctgaagttccaggtgataccagttgttacgtaccacaccgtatctacctaaagccattttggttgttacattttggtcgtgacgaatcaggacatcgtaatagcatacagattcatgataataacgtacggcacagaagcgtccgatgataccggttttcgcagtaaatttgcctgcggtaagctctgcaatcgccttatctatgtccgaaacaccctctgccacgacacccgctttttttaagaatataggtaagtctgttttcagtccgccactagcagtgttattatattcatctttaagctggtctaatgtataatagttccctttccaagagaaataactgctattttcggtcaaaccattgggagtatatgtagcttttaccactaccttggtggtgaatcctaattgctgtgccttagcttccattgtattttcaagacaatacagacttgttcccttactctgtgcaacagcaggtatctcctcactttcgctatctatattttttagataattgaaagctgcatccatattcgtttccatagtactcgcatttgatacatcaggttgttcgtcagacaagtagtttttatcctgacgataaaccgctccagtcgtggcattatcgtaagtgataagttcactatacagtttcacactcttattggtaacgcttaattcccaaccgccgaaagtaaatttagcaccatcaggtttggtagtaaaagactccttaaccacaagctctacttttgcactcaatcgatctacagagatttttgcaggatggtcttttgcttctttttttgccgcatctattttgtcttgggtatatccatccggcttatacaccgttactcccatcaatgctccttctatgccagctccttcgcctacactcgccatcatgaaattatcattggtagcgatgttggcaataactgcctcaatggcagtgttaattgcagaccaaggtttaccttttacagcatccgcagttaaattccaccctttattcccgtcggtgtaaggattgataaccacaaatacttttttagtcttctccggtactaattgagcttcactagctgcagcttccggggtccctgtcccctctgtgcttgttcctccgctattcccaacggtcaaaccatcaaaattaaccacatcaaggcacacatcttcctcgtcaaataatagaactctgactgtccctgctttactttcccctgaacttcccggtttttctactacattcgcagctcttgtagtggatgtgtgactttgcagggaaagcgacagatacgcctttccattcagctcaccgctcggaatattcccttcccgagcatcttcactactacagccggcaaatataaaaactgccaatgtagataatagaaaacttcttgttttcatcattgttaaatgtttaaatgttgtaaataaaaagataattataatatataaaaaatcaataatctagtttactcatcaattcgatattctcttcttttttggctaattcctccagattgagatttgcttgtttcaatccggattcagcagccttatttagatgtaactttgcttgttcatagtcacctcttagcagatgtaatactcccacggcattttcgtattccggtgtggaagtctctgctctctttaagtatttttctgccaaaagagtgtctttacgtgaaagtgcagccgaagcggcattcagattggcaatcttatcatcaggaaagacgctaacggctgtttcaaataattcgataaactccggtgaaccatttttgtaagttagagcgaccaaataaatttcattcaggctcaaattttgtggccgactatgaatcagcacttttgcctgttctatattaaaattctgaacatcgtactctattttacagatcgctttacgcagatgtgggtaatactcacgcaacataaaccgataaggattgccctgtttatatagcatcaacgatttcttgcgactggtattcgttcggtagtttatttcaactggtatgtgatctataatatgaagaattccatccttttctgccatgtcagactctgcaaccattttacgtagtccttcccagttttcgccaccatattccaccttgtataattctttagagaaagggaaacgagggagaaggtaattaacaagtgcctttgcacgtccttcggaaagctgtttgttaaaaaggacagaaccctccggtgaagcataaccaatgactgatattccacgaatggtaatagttgtatcatttctcacttcggcaagcatagaggatattttttccagttcgaccgggttgttcatgtaatccggccttatgatggtctttgatacaacaaaatccaggaacgcttcacatgacatctcacgtttttttacaggttcaacttgggggcggacataactgatatgcgggacgatgtgatatggaacaggcggttgctccaaagtgacggtaccgaaaagcggaaacgtcgataataacttgcccggtttgcaacagcccattacttccttttttatatccaaacgtgcatctttcatccacgattcgaatggaatgaccaaggaatatcgaatttgtttttcttcggttattccatatcctttcacaacatagtacggagcttccgactggtaaaaatcacgttcctgtgtattcattaaggccagtttacgtttcaggttttggaaattactatgccctttgacagaaatctccggtaactccagttggtggtttgcagcaatcaataccggtatcagttctatcgaatgattggaactgacttttattttatcaaggtcataaagcacttgaatatgtagggaatcccccacttgttgcaattcgatggctgttgcttgtatcgttcctttataccatttgtccggcaggttttctccatatagtaatggagaaacgagcagtgacagaggcaacagccataggatagattttagatttatcatgtttttgttattttataagaaatataagtgaaactgctgctttagtaggtccgaaatagttgcgattttctgttccggtcttttcaccacaagtctcgcatcggaacttgtcataatgtagtctgacataccctatacctatatttgcttcgagactccaacgattgcctaaaagaaaatggtagccgtacgaaatgcctccgcctattccccatccttcatagcgatagtgaccggaatcatctccaaatagaagcggcaaatgatgaccggctatgttgtactgtccgcctagtatatgtattccccaaaaatgtccgctgaatctttcacacgtccaataacgatattctaccgagccaagccaatgcaccagtttcttgtttgaggatgaatgagcggatgtaaaccagttgaagccagcacccagatctactgtacctcgcggtgaaatcccgaattcggtttccagattaggtgaactggcgtatgtaccgtagagtaggtttgtttttaccgctatcttttgagccgcacattgtgaaatgcttccccaaaatataaaaaaaagaattgctatgtcatgtatcttcattaaaatgcgtatatttattgcttattcgcttatgtttatttaaatattatatgctgcaaatttacaaaagaaatatatattaaaataaaacgttctgaaattgcacacagattccgaaatttcactcaaaatagccacataatcatctaagaagcgagttttaacactctcaaaaaaggtttatccggtaaacattgttaaattattatccattctattcaattaactttcatgacatatcggttgtttatacacgcgtaaaataaacgatgtataaaaatgattatttatatttacacgtattgtttaatgcttcaatcatccatcttgaaatatcggaatattacaactagttttgttcccggattttaaggagtcatccgtttctttaaaaggaacaaggcgttcctcggtgagaaacaggtcgttcctttaaaaggaacggttccttggttttaaaccaaaaaacagtatctataatacgctgtatatcaatttattataaaaagaagaattccgtcccgataaccatgggaatattctcaataaaccaaacggaattcacagtccaaagggctgtatatacatacttttttattacaaactttaaaaattttcccatggttacagttacaattaatatcaagccatatttggctggatatatgtatgtccgatatcgacaaagtttagaacccgatccagagaaccagtctcattcctcctctccttctccttcttcttccaaacgacttatccctatccatctctcccacattactccagtttatcacttccttcatcaactatctgtccctcatccgcaaaatacttcatggaaagaaattgggaatatttgctttgtactgcccaaaccgcgtaatgggaagaatccggaagtctataactatatcggaaacgatagtgcattgattatagaaaaggaaatagaaacggagatgaaagcggaattatactcctttctattggataataagttcaataaaggagtgatgtttaaaaagtcaatagaacaattcgtagagcactacgaaatggtaggactggtacaggaagaaacgctgatgagggcatttcaaagatggaggaagttggtgaaagaagaaaaagctataaagctataatgaaagtatattgattttgatttaatccataatgaaacgtgatatactatactaatcgcacctcttactatcgtgctgatataggatggaatattttttctttataagcgggaatgtatgttattagacataaaataatataattcacctaatacatctgcttatatcataaaataaacagtatatttgtgataaaatctcgaataaagcaattaaaatatgattattcaatttacaataggaaattttctatctttcaaagaacaatctacattgtcgttagtagcatcagctttgaaagaaatacaggttccggctgaagatataatctttaatgtaggaacttccggattatcattaatgaagagcgcggtagtctatggtgctaatgcatcaggcaaatccaattttataaaagcattggaattttttaagtggtatgtgataaattcatcgaaggatattcaagcaggcgaacgtgttaatatagaaagtttccggttaaactcacttactgcgaacgaaccaagttattttgaagcaatattctgtgatgaagataaccaatatcgttatggatttgaagcagataattcattggtacattcggaatggctttatcaaaaagccaataaaaagagagctaaggaaattgaattattctatcgggaaaaagataattttgatattcatactaagtttgtcgttggtaaagaacttgcaggtaaacgaatggtgagggcaaatgcgttattgctttctgttgcggcacaattcaatgatccgacagcagtagagataatgacatggttgaatgataccactattatttcaggttctaacgatgaaaaaatatggaatacagcaactatccaactggatgatatcaaaatgaaacagagaattgtagagttttcccgttatgctgatttaggtattgaaaatattgaaaaaattgataatgctattgtgagtacacatacgcaatatgacgaggaaggtcatgaagtcaaaactattactttcccattcaggaaaaatgaatcggaaggtacaataaagtatttttccctggcataccctatcattgatgctttggataatggaaagcgtcttataatagatgaatttgactctaaaatgcatcctcttcttacatgtagaattattgccttgtttaattcaaaagaaacaaatccccaaaatgctcaactaattttcactactcacgatacaaatttgttaagtgctaatatattccggcgggatcaggtttggtttacacaaaaagaccgctatggtgcaaccgaactttattcattggcagagtataaagtacgtaatgatgcttcgtttgaaaaagattatttatcaggaaagtatggagcaattccaattgttggagatttaacccgtttgtttaatacccaagaaaattaaaccatgacggctacaaaaaggaaaaatataaatccgcgtatcgaaagaaagataacccgtatcagtagtgtacgtgaggtgaaacaaacatttctgattatttgcgaaggagttaataccgaacctgattatttcaacgcttttcgtttgacttctgccaatgtgaaggcacttggtcaaggtatgggaacattggcattagtacacaaggctatccatataaaagagcaagaaaagctaaagggacgaacatataatcagcattgggtggtctttgataaagatgattttcctgaaaatgattttaactctgcaatcctgttggcacaacaaaacggttttgaagtggcttatagtaaccaagcttttgaattttggtttttactgcattttaatctataccaaggagcgttgcatcgttccagatatgaaaaaatgttgagcgctttgctcggatttgcttatacaaagaaatcgggtgtaagttctaaaatgtttaatactttgttttctaaacaagaacaagccattaatcacgctaaaactatcatgagacaatttgatggaaataatccagcacaacaagaatcttctactactgttcatttgttggtaaaagagttgaataaattcctataatataaatcggaaacatttgatattttttgtgtgggttgcttaatcttttcttatttgtcttatttctctcacaacattatttgctgtcctttacagcttcctcaattcgagatacaaattgcggattgctgggacgtgctgtagttccgaaatctacaatttgcccttttctattaattaacagataatagggcattctatctattttccattgtttgcgaattttctgtaagttatcttttccaaaataatcagatgcataaatacattcaattccccggttcttcaatgaatactcattcagacattcttcccattcttccttgggttcacttacacatatggaatatatgaccaggtctttggtggaatacttactccgcaattgtttcaaaggttccatttctgccaggcatggtggacaccacctagcccaaaaatcgaaatagatcacttttccgtgattcttctcaagtatattatagacgggttccatgtaaggcatagatgtttttagctttgagttttcgtgaaactcaccatataataaattattggaaactggttgcggattttccaggtaagatttagtctgattatatatctgcatcacttgtgcacgcaaatgcggcatttttacgatcgaatcaaactgcgtgtgcctcgttgttaaagcaagtgtatcattcgcattcaaagagccaactgtcattttagtatatatatactggttcagttcattctctcctactgccgacataatctcttctacagatggattttttttatctttgtatgttatcccataagctatatagcgttctacctcatcagcaatatcatataaacgtgccgaaagaatccctttattataaagcttattgattgcaggcagaagtttatgatatcggtccatttcttttttcgttttaaactggcattggttaccataggataacaaagcgtaataatagtcctgtttcagtaactcttcagtaaataacgtaacatcgtccattggcttatacttcgtcagatactcgtttctccgctccaaacgaaagtcatattccttctttaattcagtctcaaaatccttaatattcaaattcgggtttatactataattctgtatgtaatagtaggcgctttctgtaaatgccagtatttcttgattcaacttctctgcatcacctgttactttgggatgaaaaagatctttgaagtctatttccacgtgtatgctatctcccgggtggatatacaaatgttccgcataattgcgaatggaaacttctcttaattttgcataaaccggaaagcggaatgaaaatgaaccatcttcttgtatgggggtacgatattgattttccattttccaaaaaaatggaatgatgagagttaattccttttcttgaggataaaaatcccggttcaacacttttcctgtgataacagcttctttaatatattcttttgctaacgaataactttcttctgtctgtacagatgattcgaattgagattttgcccggtctttttgcccgcatccggctaataacaaagaggttattatcagaaaggaataatagtgtttcatcgtgcctgaatattagaaagtttgcaaatctaaataaataagagttcttgctcctaaatatatgaaattaattttaggggcaaaaactcttgacagacaattcgtctcaattttaaatcttttacaatatatacatttaatttgcgagataaacagacaaagctataaccagcgcacaaacttcctgatataccaattcttcacgatctgcgtcaaaatgcaataagagagcaaaatcccaaccagccaggggaaatagctcaaaggaagagctgtcaatccgatggaacgcccgaaagcggtgaaaggaataagaatacctattgccatgattaagaaggtcagtcccatcacaggccatgtggcacggctttgtatgaacggtatcttgcgggtacgtatcatgtggacaatcaatgtctgtgataacaaaccttccacaaaccatccggtctgaaacagtgtctgatgttcggggctgttgcagctaaatacgtaccacataaccagatacgttataatatcaaagatagaactgatgggacctacataaatcataaaacgacttagatcggacgcatcccatttacggggtttcttcaggaactccgggtccatacggtcaaaaggaatggtggtctgcgatatgtcatataacaagttctggatcaatagatgtatcggcatcatgggcagaaacggcaggaatgcactggcaaacatcacactgaacatattaccaaaattggaactggcagtcatctttatgtacttattgatattgccgaatgtctttcttccttcgagcactccgtcttccaataccatcaaatctttttccaacaagataatatctgcgctttctttggctatatccacagcagaatcgactgatataccaatgtccgactgacgtaatgcacctgcatcattgattccatctcccaggaatcccaccgtattcccttgttcctgcaacagagagatgatttgcgtcttttgtaatggagtcagttttgaaaataaagtggtatcctttaccgcttctttcaatgctgtttcgtccatattttctatttctatccccgtaagaaaatgactggtgtcaattcctacctgtcgtgcaatagctttcactacaatatcattgtctcccgatagaattttaactgctactccatgcgcatataattgttcgatggcttcggcagcagaaggtttcggaggatcaagaaaagcaagatacccgatcaataccatttctttttcatcttcgatggcgaaattacaatctttctcgataaaacttttttgggagactgccaataccctcatcccctgctgattcatatcttcactaatcatctgtgctttgattttcaaggcatcagtcaaggggtgaatctgcccgttgaactcggcataggaacagacatcgagaacctcttctaccgctcctttggtgatgatttgccgctttccctgcctgtcttctattacaacagacattcttctgcgcgtaaagtcgaaaggtatttcgtccactttggtatagtcatccttcagatgttccaggctcaaatctcttacatgggaaagaatcgctttatccatcaggttccttaaaccggtttggaaataactgttgaagtaagcatgacgaagaatacgtttactgttgtcgtcactgccatctgcattgatatatttttccaacacgattttatcgcaggtcaatgtaccggttttgtcagtgcagagtatgtccatcgctccaaaattctgaatggcattgagattctttacgattgttttctttttggacatggctatcgctcctttggaaaggttggcagtcacaatcattggtaacatttccggggtaagaccaaccgcaacggatatggcgaatatgaaagcctcgaaccagtctcctttcgtaaagccattcacgaaaaatacaaatggaaccataaccaacatgaaacgaatcaacaaaaagctaactttactaatgcctttgtcaaaagctgtagtggcacgatgtccgaccaggctttttgcaatagtacccagataggttttgttccccgtctcaaaaacgattccttttgccgcaccacttatcacattggaacccatatagcaaatattgtccaattcaatgacacttccttttcggaactgctgtccacgtacctccggaaacttttctatcggttcggactctcctgttaatgaagcctggctgataaacaagtctttcgaatcgatgatccgaatatcagcgggaaccatgtccccagctgccaaatacacgatatcccccgggacgagttccgtaatctcgatctcttcttcatgctctcccgcacgtttggcaagacatgtgttttttaccattttcattaaagaatccgtagcctcacttgctcgccattcctgccaaaaacgcaggatagcactgaacagcaccatggatgagatgataatgactcccgtccattcctgctctccgggatcggccatcaatacatccaaaaataaggatataatggcgagcccggtcagaacaccaatgaaaggattgataaacgttttgataaacaggataaacggattctttttctgttcatgtaccacttcgtttcttccataaatggattgtcgctcctgcacttctccctgtgttaatccaagcttggttgtctgcaagtatgaatagattgacttactgggttgtgtggcaaccaaaaatactttctctgaattgaatgtgtactgtggtgaacgcagttttttcttccataccataatctctatttttttttagttactaactgcatttattaattcgatgcaaaagtaaggaggacttcaccgggaagctgttagagaatgattagagtggtattagaaaacgattagaatttcttagatatgcgggagcttcaccacaaaggtagtgccctcatccttatgggaagatacggtaagttcgcctttgtgaaggtggatgatcttttgtgtcaaggccatacctataccatttccgggagcaatattcttgttttctccgcgataaaacagtgtaaacaggttttctttatccgtatcagacatgcctacaccggtatctgacaggcggatgattgcccattgctcccaataggctatcaagactgacgaagttcggttggaagaatatttgcagttattctctaccaaattcacaaaagcagtggtcagtaaataactgtttccaattactgtcagcacattatcttcttcagcttcttgctcaaatactaattcgatgtgataatccggatgggcttttaataccagctctctggcgtccagcaacagctcgtctaaacgaacctcttccattgtgatctgttccgactgatagtccgcttttgccaaattcaataatccgtcgatcaggtttacaattctgtgagaatcctgcaatgcattgccgatagctatctgatattgctcggaacttcgttctttcaataaagctaaatccagttcagctgtaagggctgccataggagtacgtaattcatgagatacattactgacgaacatcttttgtgaattgaaagacttttccaggcgctccaacaatgcattgaatgtcgtactcaattctcccagttcatcctgttcattttttacaggcaatcttttatcaatatgcgatgctgtgattttttccgcttctttcactatattacgtatcggttttaaagtgcttcgagacaggatataccccacaaccaccaatacgctcaatccaccgataaataggagaatgagcatgtttcttagcgcatcccggttggcgtatccataaccgtcgtaggctgcggcggtaaccacatagtctttgccctcaaacggatacaccagtcctatagcctgatattcatctacatagaaattgatgttcttccgctgtaaaatacgctttatcatctccggtgtttctttgacaatatcgttttgcagagcgtcgtgatataatattttaaaatctgttgtatagacggcaacctctacttcatcaataaacttctgattattcaggtatatagactgcatggttttggcatctacttgatttttaaggaataaatgtgctttggttatagcttcactttgaagattacgaaagaaagcattactacgcgaatgttcactgacatagtagacagccatcacaaaaacaaagaataccgcagctgtaagccctgcatattgtagagtcaacgttgttctgatcttcataatttatcagtcagtatgaaacccattccggctttggtatgaataagtttcggttcaaagtccctgtctatctttttgcggagatagttgatatatacatctatgaaattcgttcctgtatcaaaatgggtgttccatactttttctgctatttcaaccctgctcaatactctttcggcattttctaccatatataacagtaagttgtattccttaggagaaagttttatggatatgctgtttcgttctacgtctttacgttgaaggtcaatacgcaaatctgcatagacaagttcctgcggcaattcctgtgcattacccgccacacgtttcaacagcactttgattctggcatttaactctctgaaatcaaaaggtttcaccatgtaatcgtctgcaccggcatcgaaaccgtccagtttatcgttcgtcgatcctaatgccgtcaacatcaatatagggatatggggattggttttgcgaatttctttcgccagttcaaatccgttcatcttaggcaaaacgatgtcagatataaccagatcgaatgtgtgcgtctggaaaagccgtaaccccattagtccgtcataagccaccattgtctgatagccattttcctccagtccgttcatcagcaaacttgcaacccggggttcatcttctataattagtattgtgtacataggaaagaattcattaatctgaatgtataaaacgaaacaaaaataatgattattccccacttatagcctttttccttgaaaaatcggtgagaaggccaaataaaaaaggtacccaacgcaatgtggatacctttatatgattcatttacataaaccggaaaatgactcgtccggtttgtggaccatttacccatttcggttgtgaagagggaccacacaaatcggtggagtttactttattacgtaccggaggaatcacgttcaggacagagattccgctttcgggaagagtataaagcaaacggtcgcggccatcacgaggctgatatactcctatatacgtgtcgggagtttcgtttgtcagactgatagtgccttctttcgtttggatattcatccaggaaacatcaccaaagtatcctttgaattcgggatatgtgaaggtctcacccggaataggatcgttatagtcgttttcccatacatcgtattgcgttccgtgaatacggttttgccatacacggtaaggtccggcacccagccagcgtttgctgattacctgatcttcaggatagtcgaaacgaatacccatcaagtctacgacaccggagaaattgtaggtgtaatccaaagccaaatccccactcgggttaattgtccattgggctttatccagattgcccagtttataattggcggtaacaaccaaattacctccgtcttctttcacatccagtttcgtaaatacggcagcatccgggaattcgctgtatgtgcggtctttttcttttgctttctcatcatcatggttatagaactgatccaatgagcggtctgcacgacgggctccgatgaaacggggaccattggcgaagttaatcttacggttatctacagatacccctttcagttgtccgtctttctttgagaaaatgaatgtacgcttattcgctttcacagtaagatcattttctgtctctgtataagtaggacgactagacaagggagaaagctgttctgtctgctgattcagtttgttgaccggaaaagtccagcgccaaagttcatggccgtatttatcaatagctgtcaggtaaagagcatctgtatcagcgaggatatttgttcttatatctaagacacctgccgaatgagcagccacatcactaccctgcacctctccctctttcagcacttgaacagcagcattggaagcatctgttgccagcgggaattttacttgcttccaaaggaaacggcaagtattcagattcagataatcgtaacggttttctacggagaatttgccatcaaattgcttgtcgatagaagtattcatgatttgcaccggactccataactgcttgatagtgtagtagctaccctccttttcgtgatgtggtcctacaattccgtctgctccaaagtttccctggttatcgatgaatccgtccatatctacacgcttcacaccttcgtctgccaatacccaaaggaatccaccgatacaacggggatgcttgcgcatcatttcccaataatcgtataatccggcaccatggccgccatcgtataaaccatgcaagaattccgtaggcataaagatttccggtaagcgcatgtagttctggctttctccgtaagagcggtaatgcatggtttcaaaaccggagaagttaccttgcgggtgaataaccggacgtttctgcggatcgtatttatgaaactctccatccagttcggtattccatcctttttcattaccattactccaccaaataatagacggatgattcacgtcacgttctatcatgccttcaatcagacgtactccggtgggggtatcatacttgccatgccagcctcccaactcatccatcacataaagtccgagagaatcacaggcttccaaaaattccgggtcagccggataatggctcaaacggacggaattcatattcatgcttttcatcaaaagaacgtcttcgatattcttcgctttacttaatgtacggccactttcaggacggaaactatgacgattgacaccacgtacattgatacgtactccgtttatataaagtccgtcgctttcacgtacttcaatggtacggaaaccaaagttttccgtttcactatgcagcactttaccgtccttatccaacagggagaattgagctttataaagattcggagtttccgcagtccatagtgcagggttagagacattcagttgcaaagaagtccagtcgccacccgcttttacaggtacagtgccttccgctaacttctttccttttttatctaaaatctgtgtacggatgctcattccgtcattagaaatatttgtgtagcagttggcacggaaagttccatccatctttgcgtcaatggcaatgtgccgcaggtttacggctggtttcacctccaggaacaccggacggaagataccgccaaaattccaataatcagcacgacgttcggcaaggttcacactggcattttcactctctttggcaacagtgacttccagtaaattctttttgccatatttcagaaaatccgtgatgttgtatgaaaaacgatagaaggccccctgatgtttggaaccaactttacgtccgttcacttttacttccgtatctgtcattgaagcttcgaatacaagattgacctgtttgccgcgaaacttttccggaacttcaaactcgtacttatacatacctttttcattggcaacgccttcagggaatggtttaccatagaaagtgattccatactgataggtgccgaatccttgcagctcccagcaggaaggtacaccgattttcgtccatttcccggaattgcgtccgtcggtacaaaagaagtcccattcaaccatatcgtcgcatccgtgaccggagagatattgcctttccgtttgtggaaggttttgagcagccagggtagttgccaacgctaaggtcgataataaagtggttacttttttcattgttacttttataattgtgttagttatttattgctatcattgtttactactgatgcggatatgcagcgtatgttcttttttctctatggcatatttcttcaatacacccggtccgcaactactgtttcctaatccaagtacggcagcatccatactaagaatgatttccgcacgtggttttaaattacaatcgtgagtttcttcatagatgtcctgtacggtgtaatgcagggcagatgcagaaaatgcgttttctaccgcgtcaacacgaatacctttattctgtttgtcggtcagggtcagataatgcacttcctctttgttcccactatcctgcggacgtggataatgtacgtactgttctgcaacgcttcctttccaaagccctatcatagcagatgttttgcggtcaggatagttatcctgtggccctctgccataccaggtaaatgtatcataagcaggcgccagacagaatgcgatacctaaacggggaatttcaggaagaactccttgtggcaagaaagttgttttcagatcaattgttccatctgaaaagactgtatagacagaagtagtcaccacttttccttctttatataaattactagtttgaatccggacaatgaccgccccgtctgcacgtttttcatggtggaaagattccagatttatctgcggatgatccattccatgcaatttccagtctttagccaaccagtttccgaagctcttgtcattatctgtcggagcacggaaaacttgagtgacaggctgaaccggaaaatcatcggagtgagccagcatttctttgttcttatatataagggaggtcatacttccgttcactttcttttcccactgaacagaaaaaccgcgtccgctaatcaataaagatttatcatcctcttccacttgaagcgtttctttataaattaaatcagcagaagctaaatctcctttttgcaaacagaattgttcccaggccacttcatgtcctgcctttgcccaaagagcatccgatttcaaaacaatgcttactttcagttggcaatcggaaagaggattcaatgaacggaaagtcggcaaatctattgttccactttctcctggagctatttccggcaatgtaatttctccttgttctttctgttttccatccacagacaatgtccataagcagcgataagatgataaatcgatatgatggttccggttcgtcactttcagcttcccattttccattttcagttcaactggtgcatataccttctttacctcccaatatttaggcgtagtttcacggtcactcatcagcaatccattaaagcagaaagcttttaaattcggcttatcgccaaagtcaccaccataagccaccatggtacgaccgtcgggtaatgtcttgtagattccctgatctacccaatcccatataaaaccacccagcatacggggattactatatatctcatcccaatattccttgaaatttcctaatgcattccccatggaatgtgcatattcactcgtcatcaccggacggtcgtcattggtacgctccgcaatctccagcaaccgttcccaacgtgcattttcagcgcgttctttatcctctccttctgcaataccgggatttaaatattcttgtttcacccgggtataaaagcggctgataacatctaccgtcttcgggtcaggatttccgtccactccctgcgccccctcatagtgtacagggcgagtgggatcgaaatcatgcagccatgccgaaatagcagcgaagttcggtccgtaaccgctttcgtttcccatgctccacattacaatacatggataattcttatcacgttccgccatacggactgcacgatccataaatgccgcatgccagtcgggggtacttgcgagtgttccacgcaatccgtgttcttctatatccgcttcgtccatcacgtacaatcccaagctgtcgcatagctcgtaccaacggctgacattggggtaatggctggtgcgcacagcatttatatttgcctgcttcattaaaagaatatcctgaagcatccgttcttcgctcatgacacgtgccgtccgtggatcatgttcgtggcggttcaccccacgaaaacgaaccgcattaccattcactaacagttgtccttttttgatttctacagagcggaaacctacggcctgttctatctgttctacgacttttccttcttcattttggagagttaagtgtaatttataaagatagggcgtttctgccgtccatctttccggtgattttataatggctgacaaacgtcccattttacgcgggccacgctgcggataccattcattcatccggcttgctttatgctccaaatcaagaatatcttccacatcgcctttcaatgtggcaacttctttgcctgaagcatccttcagtactccctgtaaaatatacccttttccggtcatccctcgatatacactgaattgcggatcaatctgcaaaataaagtctttataattaccaacagatgcgggaagagtacgtaccgcataatcacggacatgaatatccggcgtatgtatcagatgaatactacgatgaatacctccaaaacgccagaaatcctgatcttccagataagaaccgtcactatatcggtagacttccagtgaaatctgattttctccggatttcagatacttcgtaacattaaattcgctcggttccatactgccttggctataccctacccgttcgccattgatccaaacataaaaggcgctcattacaccttcaaagcgtagaaaagtctgtccattcacttcccatccggtcggcaatacaaaagtgcggcgatattgccctaccgggtttctttctttatacgtggtatagtcagctttcggttctcccatcacccgtggaggatctattttaaacggatagcctgctgaaacatagataggcgtgccatatccgttcacttcccagttggcgggaacaggaaaatccgtccaatctttatcatcaaaatttgtctgatagaaattcatgactctttcattgggaacgggagtccaacggaatttccaggttccgtctaaagagattgaaccgtctcctttctgtacagagaaaggggtaaaagcggctcttgccggttcacgattgatctggagaacatgatgattctcccaatcatgcattgtttgtgcctgtgtaggacttacaaacaatgcgccaagcagtaaagtatatattttcattcgttcttttttcttcatatcaagtagacgaacgaaagggcattttgtacccctttcttttacagaaatattaaagaacaataaaaggagtaacactctataaagaaaagctttaccttgtggcgtataattacttctaatattatgatgatgaaaaaactactatttagcagcctctttttatttggcagtctcgtttcacaagcacagcacgagtatacgattgaaggtaaagtagaaggtgtaaaggatggaactcttgtttctctttttctacttgacggaaatgtaggaagtacagtagccatggataccatacaaaacggtactttcttcttcaaacgaaatgccggagaagatggtttagacaaattatctctaatgtgtacccgtaatgatgattttccttccatgtcgctggagatttatgcgactcctaaggcaagaatcaaagtaaccggaacgaataccttgatacatacgtggacagtagacagccctgtaaaggaacaaatagaatataataggtttattgaagattcacacgatttatgggatgagtatcaacgtttgtctatcaaagcaagaagtctgcgttctgccccggaaggcgaacggaaggctctacgtgcgaaagaagacagtatttcagctttaatcagcaaacgtgaaatgaaactgatgcaggaacttcctgtatcaaacatttggatggacaggctatataaattgagcatgtcagtgaagtacaatccaaatttctcttataaagatgaaacactggctttgtataatagaatgaatgaagcacaaaaaacttctataacaggacaggaaattgcagttaatcttttcccgcctacagttgtgaaagagggagataaaatggcagataccgaacttttcgatttggatggaaagattcatcatctgactgatttcaatggaaaatatatattgcttgatttctggagtagcggttgcggtccttgcattatggctttaccagagatgaaagagattcaagaacaatataaagagcgtcttactatcattagtctaagctccgatacgaaaagcaggtggaaggcagcttcggcaaaacatgaaatgacctggcagaatttaagtgacttaaaacaaacagccggattatacgctaaatatggagttcgaggtattcccaattatgttcttatctctcccgaaggcaaaatcatgaaaatgtggtcgggctatggcaaaggtagtttgaaactaaaaatgcgcaggtatctggatgctgtcaaacatgaaatgagtattacatggcaaggaaatacaaaagtcgttaactatccggtgtcggaatcaaccaataccgatattcttgaagtcaagcaagtggtactgacagacaccgctaccatcgtacatttcaacgcttattatattcccaaatactggatacgagtcagcccgaattgtagattggtagatgagaaaggtgaaacgtataccttaaagaaagcagatgggattaaacccggtgagcacttttatttgcctgaaagcggcgaagcagaattttcactcacattcgaaccgttgtcttcttctgtgcaatcattcaatttcactgaaggaacagaaaaaaatgactggcaaataaacggagtgaggcttaataaatgagtatcgaatcttaaaaaaggaatatcgtattaacattcaatgtgttgcaaattaaaatagctgtataaacaggtacaaaaggtttgttgaaataatgttttcttcagtaaaatggctttctttgttatgaatttaattattatcttgtacattgaacgaaaaataacaaaatatggaagcgaacggacaaacactctacaatgatgatttgcttaatatcctgcctgacggagttatcatattggatataaatagagaagtcatacaactgaatcagcaagctcttacggaacttcatgtacattcgtcagtcaatgcgatgatgcctcttccgaccaacaagatattcaagctgttaaataagaaagaagatatactctcgaccattttggaagaaatccgtcagggcaaaaaagtatactcgctgcctgaacatacatttatgcaggaacaagttgactatacacaattcccgataagaggagaatttgctacaatggaaaatgaagagggcgaaaaaaacatcttgttctttttccgtaatattactgtggaactgacacaagaatatatattaaatacagccttgcaaagaactaggatatatccctggtattatgacataagccgtagtgaatttactcttgacgatcgttattttgaacatttaggtattccagccggagagaataatactttgacaatggaggaatatgtgaatatgattcatccggacgatcggcaaactatggctgacgcctttgttgtacaacttagtggtaatacaacttttgacaaaacagttccattccgtttgcgccggggggatggtacttgggaatggtttgaagggcagtcaacttatattgcaaacatatccggtcatccctatcggttagtgggaatctgcttgagtattcaggaatataaagacatagaaaacaccttaatcgaggcacgtaaaaaagcagaagaaagcgatcgtcttaaaatggcatttttagccaatatgagtcatgaaatccgtacgccgctgaatgcaatagtcggcttttctgatgttataggttctacttatgatgagttaagtgaagaggaacgtgccgatttcgtgcgactaatcagcatcaatagcgaacatttagtacgattgattgacgatatacttgatttgtccaagattgaatcaaacactatcaagtttacttattccaattattccctcaaatccataatgaaggatatagagaaagagcaggtcgtgaaaaatgtgccggaaatcgaaataaaagcaatcttgccggatgatgatatttacataactactgacgctacacgcttgaaacaagtaatatgcaatttcataaataatgcccggaaatttacagaagaaggatatattcatttcggttttatggttaatccggaaaatgacgattcagtttgtctgtttgtggaggacacgggggaaggtattccccaagaatgccagaaagaaatattcgaccgtttctataaagtcaatactttcaagcagggtacggggttgggactctctatctgcaaaacgattgtagaacatctgcaagggagtatttctgttgtatcagaagtaggaagaggcagccgttttaccgttacattaccactcgaaaaacagccggtggaagcttaatgtcctctgtattcctgtggggtaacacccgtatgttgcttaaaaaacttattgaagaaagagatattattaaatcccaaagataaggcaatattcttcaccggttcattggttgacttcagccgggatttggcatccatcagaatgatggaagctatgacttccaaaggagtgtttcctgcaaccttttttattgttgaacagaaatgcggcaagctaagtcctagatgttcggcataaaaagaggttccgtgatgaatagtataatatttcatgaccaattgcaaaaaatcctgataaatctcgtactttcttgactgggaagataaatacaagttattttgcattttataaatttcagtggctccctgaaggaacatggtaagaaccgcctttactatttccttgtttgccaatgtttttggagaagcatacgaaagaattgacgattcatagaacattttataactgcaagcctgcaatggagataatcttattatcggattttccataattatagggagaagatgttctgtagacttcattagatttataccctctatgaatccggatgagaacccggcataatagatatgaatatccggtgaaaaatcaagaatttccataaaatatccgggcggtaaggttatcaaatcattttcaccaatattttgaagattcccattgattgtcgtttgcattatcccttttacacaaagaatgaaaaaaccggcttttaccctgcaaggaaagtttttatacctttttaataaatttatcccatacccttctccaaccatataatcagacggcaaatcaaaattaggtaaatcgctctccattgtgttattttgtttttgatttcaaatatagggattatttgaagtttctccctcgaataattaaaatcagaacatcgaatcttaaaaaaataacatctatattttatttataagaaagtatcagaatatgaaaagcaggacaccggaagtatattcaaacttcttaatgtcccgcttctatttttctgtttatatgtgtgtttttctaaaaaacttattgaacatccaatgcatcgaatgccagaccgtccatattttctgccgaaagtaatactttgtaatgtccggcattgataaaggttccggtagtggtgctcatcatcttccatttatccggtgtttccgggaagttcaatacgtcctctttcaatactactccttttgaatcaatgaatttcatcaagacaggtattggctttccggtagtattcatatatttaaagcgaagggcgtacacttgtgccaatccggtagaaacattccattcaatgctgttgccttttcctttaccaaaaaacactccgatctgtttgcgatgttctttcttttggaatttgcctttcagtacagccatttccgcttcgtatgatatactgacacgagcatttttgtcttccggaagtaactctttcggagtcttttccatcacttctttatccgccttttcccagctccaaccggatgcagggaataccgtcggtttcagttcctgatctatgctggcaatagcaatgcctgaaatcaaggcttgcccagctttcacttccgggaaatgaattttcaacattccacctttcactgtggtatatactatctttttacaaactccgtcatgaccactttcagcccaaatatccaaatcatctaatacaacagaatcattcacggcaacatcgaatatgcgcaatccttcacagtcggtagaagcgcttccgcccgtaccatgccaaggctctgtgaaatatagttcaatacgatatgttccgtctgccacagggaagcgatattccagctgatgacgtccgaagcggaaatgttggaataacgtccagtcacgagtgccacgaatcggatcattggtggtacgttgactggcaaggtaaggattcagttccttgaaattctccgcccatgaatgggaataattcgtattatcctgtaaccacagttggtcgaaactatctgtataatcatcccctccacagttgatacgatacagataattatatcctgcctctcctttcaatatctttttatcatcctgataaagaagttcgaagttaggggcctgctccaagccgttgaacacgatcaggtcttctgccaccggcttacctttataataccctacagcacgaagtacgttataacgaatatccccgttttcccacataaaatgagtgcctgtcccattgttctttttacgtccaaggaaggttgccttttcatttgtcagatcgttgtagagcaatacagaatcacaattactgtaagcctcaatagtggcacggcgacgtcctttttcaaaacgattagcccatgtatgtgataccaggtaaaccatcgggtcttttgcagccggaacatagttggcgcgatacatataatatacgtctaacggttcttcccacggagtaaccaatcctttataattgaacggacctactttatctatcttgcgatacgcttcatccggttgacgacgtccgggattatcatgactgctgtatatccactggaattgtccgcaaacactatctttagcctgttctgccaaacggattttagtttccatcagctgacacatacggtcttcactccacactccgttcacctggaaatctcccggttccgtatgcaggtcgatacttctccacgctccatattccccgttcaataattggttcgtttgagagagttcacgaccgtatttcgtcacatctcctccatacgtaccactccaattttgaattacattccagtctgtaccttcaccgccattacaggttgttatgacacgcattgtctttgcagtcggatccatctcccgaataatatcactgcactcctgtgcaaactcacgaggcaaagtgctttcattctgcaatccccacatcaccactgacggggaattacgacgttctttcacccattgacgaagcaactttttaaagttctcacgaaactccggagtgtcataccacacatgggcggaaaattgtgtccaaaacaagattccctcttcatcccagtacttctgataatcgagatgatggggctgatgagcatcccggaatgcattgaaaccggctgcacgtatctgttttacccttgcggcaacctgttcgttactgaacgcatggctttgtccgaactgatgctcatactcgcatactccattgataaacaccggctttccattcaggtaaaaacgtccgtctccatcgtttcgttttaccggccagctaatggtacgaataccgaagggggtcgaaatttcatccgtcgtcttcgtatcacgcttaatcatgctagccaatttatagagatacggattttccgtattccacaaaacaggattctcaacaggagcctgctggcgaatcactttcatttctcccggagctaaagtaactttctcaaccaaacggaaaacttgttttccatcggcattgcttagtttattgactaactctaccgtttctgttgttttactataattttttatctctgtttcaacaaatacgttagcagctttttcgtcattccaaatatgtacaccgaaaggttctatacgaatctcatccgttacttccaataccacaggacggaagatacctaacggctgggaaccctcactgaatccccattccgacgaacatcccccgcatacccaaggcatatcggcgatcatttcaggatgctcggctttcacttccaggcgatttactccctgtttcaattcatctgtgacatccaaagtcaatgtggtgcgccctatgggatgacgaccgaaattctttccgttcactgtaatagtggcgtatgtacccactccttcaaaacgaaggaaataccgtttcccggattttacatctgccgtgaaatctttcacatacatagctgttccatgcaggtttccatgtgtcaactgacggtatccataataatcgtcccaattatgaggaatattcaccgtttttgcaggcatcataaaattacctttcaagtgagttgcctctgtaatccaggttttccaaccctcattcaatgtcatgatttgccggcgattcttactctccggaaccgggaaacggacggccgaacgtcccatcgacttactggtagcaatggcaatgccacgttgctctgcgttgtttaccgcacaatagaaatgataaaccactccgtcatgtttcaccacatagctcttatgagcaaacagttcatcgtagttcttggaggggataatcaggtcggcccctttccaatcagtccagttcaccaaatcatagctggcggcaaatgtattgaatgctttatatttacgcgaaggttcaaaagcagagaaataaaacatcacatacacatctcccatcttttggatatgcgcatctcctgttatggttccatctgcttcatgcgcaaagaccggattgccggagtagcgtttccatgttttcatatctttggaaagagcaatgccgacacgttcgccctttaaatccgtttccggatgacgcccgcccgcgttgtaatacatcacaaacggagctcccaatgttttatctttatcccaataaacagtactcttatattgagtcagtttttcccaccattgggcatctttatcatggatgctcaaaatcggtttgtccatagattcccattcatgtgccgtagaaatatctcctttcgtccatgccagtccgacataaagcggggcttttacagcttcgtaacccgttccttcaccaccgatataagtcatccaatggcgacctttataagtctgaagctcatagcttccaccccattccatatccggcaatgcaggaaatccgccacgctgattgcagtcccattttccatcccgataagaaagaacccgtcccaaagtacgccattcgagcagattatcactttctgctatccacgtttcgtaaccacgaccatcggttccacctttaccgttgtaaaccacataagtcatcagccacttgtctccctggcgaaaaacggtaggacaatcaatcttatgataattgtctgccggggcaactgcaagcccgtatttgtatggtgtctttacttcctcataaatctgctccattcgttcctgcggaacttcccgttgcgcatatagagagaaagtggtggctatactaaaaactgccagcaataacttcttcatgatactttttctaatcgtttaatacttaaatagtgcataaccactaaatgataattttgcggagtgccctgaaagggcttaattatatagcgtagggcaacgccctacgtaaaaacgacaatctgaatttgcgccctgaaagggcataattgtatacagttccgccctttcagggcttgtggctggtgtgtttttttcgtagggcgttgccctacgctatagaattaagccctttcagggcaccccaataaatatataattgtaaggctttcagcctaactgctaaattcccattagtaaaacaaccaatccattgtctcttcatccccggcaagcccggcattacgcactttcgtttccgcagccgtgaatcccaacacttgcagatagcctttgggtaacatcaacgtatgctttccagccggaaaactatatgcatgcacatttgccaaaggcattccattgatacggacagcattcgtcaatacaggttccgcctgaccgtaatcattggctgacgcatcgatttccagtttcggagcttttgcatactttttctggtcgtctttgaaataggctactaataatttcaccggagcatccgtttcgaaagtgatgcttgtgcctttctctctctgctcatttccattaaagcggagcgccttcattcctttcaattccggagctactgcttctatcttacctggaacatccacaaataaagaaataccctcatccactttcactgtcggataattagaaatcagtttcacgtttgcaggagtccaggcagcaatctcgacagtttcagtcaccgcatttccattctgtttttctttcaacaaagcgaggttggctttgaaattttccaattccttctcatagtgtaccagcaattctttccaagtcttattctttccatcatctccaccgataggaatacgacgttgggcagtctgcatactgttggcatacaagtaatgttcgtccgtcagttccaccaatttgcgatagtgttccaagctttgttccatcaaaggaatagcttcttcaagattcttaatctcttttccccattgataatccaataccagtttggcagctttcactttcaggttgaacgcatacgcaaattcacgataacaatgcatatcattctgcaaacgtgcaaattcatccttatttgaagagacggaacctgctgctttatcaatagccgctactgctttatctccatgttctattacttgagcaacaatatccaaaggcatttcacctacatgaggttgctttttccattctttttctacatactctatcagcttctctccttccggtccgcaactttcatagaatcccggatagatcgtatatttgtacggattgacaagctgactcataaacatacccagtaataacgtttggcgatttccctctgtaataccgaaacgacgtaacaacttcggagcaatctctccgctttcttcgtatgctacacggatattacttgcattttcgtcagaggttccgtagaacttgcccaactgatggtcccagtaacccatttcatctgtacggtcgcgatggcagttccacgcatagcgtccccaggtctgataccagatccaatcgcgatccaattggaattcacgttcattgtttggtaatttgtccgccgtataaggccagtcccaatatgaggcctgcggataaaggtgcaacgcattggcaccgtgtacattgtgcatggcagtgaccgccttttgtacgaaatccggagaaccccagcggaacggttccaaatttgccaggatatgtacgttactgatatgaatggaacccaacgaactcaaatccgtatgaattttcgaccaaggcccacgaggttcgtaggtagtcaacgattcaccattgtacttatgcatcgtataaagattcttatagagcggcaaggcagcgtccatcaccagtttgcagtccgtgtcgtgcgcacgcaacaaaagaggcggttcatccgtacgtcccaatgcctgtaatccgtctttcactcccggaattattgttttggtaaaccattccacatcgtcctccactgtacacatcgcttcacccagacaaaccagtaatcctacattgggatatttttcaatgaaagcggcaatactcttgcgtgtataatcggcaatcagaggagtaataggacggttacgatcctgtgttttcagtccgtaatgttcagcaaagggtttggaaagaatgatattataaaacatctgtatgacaaagataccgcgcttgtctgcttcttccgtgaggaaagagaacatttcttcgttcattttgaaggtttcttcatctacttccagtgcaaacggataatcttccagtttcaccaatgaggcaaacggatgtccattccaaaggtacagtgaattcatgcggttggcaaccagcatatccaagtatttaatccattgttctttatcataaaaccaggggaaactttccggagtatatggatattcgtatacgccatgtcctggcaggtaggtcatcttctgtaaccctacacatgcaccgcgtaataccatttcaggaccgtctttcagttcctccgggaagttcaacttaccatccgaatcattcacacggtcaatcagttcacggcatccgtaaatgacaccactcccatccctgccggacactctggtcagattgcccgtcgtcgaaatatgaaagccttctttcttgagcgtcgtgtcatttacttccgtcaagagaatcgttttgatttcgggatcggagaatgtcgtgtctccctgttgcatcattacctgataaccggctttatccaaggtagtctgtaactgctccgcaccaaacagaacacgatttgacgcatccggcggagtcataatcttcacggtttgcctgccacacgctgccaaaaaaagtgtgcatgccgcaaacatgaataatctggtatttttcattcttctgatatatattatagattatataattcatttcttcactaagagaaagacgaaataatcccctgtttgtactcattcatctctttttccacttttcagcaccaaatttccactttcatcctgctgtgatatgcaaatgcctcattatttaaaagttatgcttatctttgtaggctagtgtcttataatataaaaacagaaaacaagagcaaacaatatgaaagaacaaacaaattatgactatgaaaaatacgttcagatagcacagatggccaaaatgggatggtgggagtcagatttgaagaataaagaatatatctgctctgactttattgttgacttactcggccttgaaagtaaccgcatcagtttcaccgaattccaccaaagaatacgtgaagaccaccgactgcgtcttaaaaatgaatatatgtctctttcttatctggagacatacgaacaaatgttcccaatccgggcaaaagacgggggaaatatgggtgtactccaagattaatttccaaaagcccgatgaagagggatataggaacatgacgggccttctgcaatatattgacagaccgatcgatactacgaatggaaacattgatttctttcaagtgagcaatttgctttatcaacaaactaatatttcatattcattgcttgcttttctgcaatgtgatgatgttactcaagtggttaacaagacgttaggagatctccttcaccaatttttgggtgatcgtatctatatattcgaaataaacagaaaagaacaacgccaggattgcacttatgaggttaccgccgaaggaatatccaaggaacaggagttcttgagtaatattccctgggacccttctacctggtggaaccatcagatagccgaaagaagggctatcatactgaacacgctggacgacatgcccgaagaagctgcggaatatcgtcagacgttggagatgcaggatatcaagtcgctgatggtagttccgctaatctctaaagaagaggtatggggctatatgggaattgatatggtaagaacgcagcgtagctggagcaatgtggattatcaatgcttttcctctcttgctaatattatcagtatttgcatcgaattgcgaaagtcggagttacaagccaaagaagatcgtcttgctttggacaacagcgagaagatattgagaaacatctataagaatcttccggcaggcgtcgaactttacgacaaagacggttatttggtagacattaatgataaagagcttgaaatattcggcttgtctgacaagcatgaggcattgggagttaatctgttcgacaatcccaatattcctttagaggttaaagagagattgagagcgaaagaagatgtaaacttctccatcaattatgatttctcaaaaataaatcaatatgtagatagtcggagaaatgggattattaatcttaccactaaagttactgctctctatgattctcaaaatcgatttatcaactatctgtttatcaatatagatacgacggaaacgaccaatgcatacaccaagatacaggagtttgagaatctgtttcttctaatcggtgattatgccaaggtaggatttgctcatttcaatgtattgacaagagacgggtatgcccaagatacatggtacaggaatttgggagaaaaagaagggattcccatgccacaggttattggggtatacgctcatgtggtccctgaagatcaagctgtcctgaaaaattttgtgcgcgaagtgaaagaaggaaaagcgagcagtttacgtaaagaagttcgcgtctgtagggagaatggtaaatatacatggaccagtattaacgtaatggtcagagattatcgtccgcaagatggcattattgacatgctgtgtatcaattatgacatcacgcctttaaaagaaactgaacagaaattgattatagcccgcgataaagcagaagaactggaccgtctgaagtcggctttcttagccaatatgagtcatgaaattcgtactcctcttaatgctattgtcggtttctccagtcttctggcagaaacggacagcagaagcgaacggcaggaatacattaagattgtgcaagagaataatgaacttcttttgcaactgatctcggacattctcgatctttcgaaaattgaagcgggaacattcaattttgtatataccaatgtagatgttaatgagacttgttctgaaattatcaaatcaatgggtatgaaagtgagtaaaggtgttgaactgatttttggggaattattcccggaatgttatatctacatggataaaaacagattcacccaagtaatcagtaactttataaataacgcgttaaagttcacccaacaaggcagtatcaccctgggatatgaacaagtatcccatcagaaaataaaattctatgtgcgcgacaccggaatgggaataccggaagaaaagcaaaagagcgtatttgaacgttttgtgaagctgaatacttttgttcagggtacaggactcggactttctatctgcaagagcattgtttcccaaatgggaggagaaataggcgtggattcgaccgaaggagtaggttcctgcttctggtttacacatccgtaccacgctgctgactagactgattatatgtggaaggggatattcgatgaatgatggttaatacttataataacgaataacttccaataaggaaaaaagaattgtacctttgcattctattattatcatagttatgcaaaagtatatagaaacaccccgtctgattctccgagactggagagaagaagacatcccgttttttgcccgtatgaatgccgatccgaatgtgatggagttttttcttaattcattgtcatcggaagaatcatttgccttttatcagcgtattcaaaatgaattccaaacttgtggctttggtttgtatgccgtagaacgaaaagaagatcatacttatatgggctataccggactacatcagattacatttgatgtagactttgctccaggcatagaaataggctggcggttagcatacgaatattggggacagggttatgctcctgaagctgcaaatgcatgtttggagtatacgcgcaataaaacagatataaaagaactcttttcttttacttcccttctcaaccaacggtcagaacgtgtaatgcagaaaataggaatggaacgaatgagggaattcgatcatccgcttgtccctggtgaacatccgttgtgcagacatgtattgtatcacatcaaattttaaaaagctattgactttcctcttttaatttcgtatatttgcaatataccaattagctgacaacagatatgatatatacaaaaataaagacataaagagatttttcagaaacataaatatgtttctgaaagaatagaaacggggtgaaatctgcatagatttcaccccgttttgtttaatatattcgcgttttattagtgaattacccaaaatatcgtttattataaatgtaagacccgtttataataaactgttccccattttattataaacgtctcatgagtttattaatgtcttgtataagaaaaagaaaataacgtaaaggtagtaatggtatcaacgagacaaacacaaatatatctacacatttatagtaatgaacgacctttacaatttgatccttttttatagtttattcctttggatatcgagcgtaaaagaaccgatcttaatgggaattatttagttaatgaacgaatacattccacttcttctgccgaataaggggtcccatcactacggaatatatcgtggaaccacaatagaggttcagaaacatcaagtaatggagtgtcccatgcatagatcgtatttgtttttccggctacaagtccccagtttattgcaccgatattctctttcttcagcattggcataatatcttggaaagtgctattttgggtacgcgccatatattccgtacaaatcatcggacgaccgtattgcttcaatgtatcaatgagttactgatgcgaatccaaaccttcatacgtgtgatatgttatcacatccgaattttccaattggaatttattcagattagtcaggctcatatcccaaactccggccgacagaggttgtgacgaaatccttctttatctgtttcccaaatcaggtgatgcaaatatacgcgcatacagttcatacctatttcttccgcccaacccagttcacgatcaatagtaaccggatcaaaagtatctgcctgctacatctccatttggttgattgccgtgctcggaataaaatcacacccacgaagccatccccattgcttataccactcattagcctgctcttttgtccaaacttcacgaacagaaacagttttctgactacaggcaatcaacataataccaataaaaaatgagagtaatatctttttcatataatcgttttactttatcaaattaaaaatcttttttattttctccaatacaattacaaggagtcaatcatatcacttcaccggctttttcatttgcacgatattttgaaaatagcaacgcacctttgacaaggttatcttgtaatctcaaaaggtacccgaactgaaacacccgttttcattagttcagtgatattaggaagaacgcgtttcttaaaggattcccaaccacgattgtccatttgtgtccaacctgcttctgccagtgcaaaagcacgtggatatgtcatgtatgtagcacgatttatatcgataatggcttccccccataatggtcccattactccccaaatatgcttctgtgcctccaaaggacgaccatatccaggatctaatttatatgcacgttctaatgtggtaataggcatcccccaattattatattccggtaattctcccttatattgtggataatcaaaatatgtatattcgctaggggccataattacattgtgtcctttcttggcagaaaaatccagccctgttggagtcataccttcacgccaattgactaacgttacatcttgaggatatgggaatagataatcgtcagcaggcggatacacattgttcaattcaagccacaatattggtttctttccatatttgcgaacagatcctaaaatattttcaaaaaaaggaatcatcaactgagaaggcttggtatattttctcttttccatcaaagtacgacacaaatcacactgtgcccaattcttaggtatatcagcctcatcacctcctaaatgaattaacggagatttaaacatcttagcaacttctccaattatatcatccatcacagcataaacctcctcgttaccggcacaaagcatcatgtgacctgtcttacctataattttttcagtttgacgctgatgaatacaagccaaatttggatattttgacaataaaaaaaccgtatgtcccggcatatctacttctggaatcacttgtacatgacgcatagctgcataatctaccaattcctgaatatcctttttggtatagaatcttgcacctgccagactaggatgactttcaatccaaatactccaaccgtgatcatctgtcagatgaagttgtaatacattaaatttgtatttaaccatttggtcaatatagaatttaatatcatcaataggtaaaaagttacgtgccgggtcaagcatcaatgcacgataatcaaacctcggacaatcatcaatttcaacagatgctattgttttttgttttgtagcacaaatatcacccgccaaaatctgatccaaagtcatcaatccataaaatacagcagcagaagtagctcctttaattaccaatctcttttcatttacactcaattgataatgctcttttgtttttaaagatttatcaatcaatagctgtactactgattttgagctctctgtagaacgtttcacattgattccgaatctcttattaaaaatagaagaaagcgtattcaactcaaactccaaactatcagtctcaatataacaattgacttgattctctaacaccaacaccatgtctgaatctgatgtgaccttattgggcatcggaatcaatgcagaaagattatcttgtgcatagatacaacaaggtatcatcaaaagcagaaataaagccacattcagaaacttatttttcataatacttaataaatatttttccatttattcgttgttgtaaattcttttttaattatcagaaaaagacgacaaattttattgggtgtattatctttctcttatttcaatagtccttccaccattacaggaaaatgatctgaagagtacttattatactttatatcatcatcaatggtgtgataagaaagtatttttatttttggagtcacaaaaataaaatctatgcgcttagctgtttttccagttttgtcataggcataaaaactaccggacggtcctttaggaggcgtcagagtacattcatacgaatcctgtaataaactatctttcaggagaagttgtatcggttcttcgtccggagtggcattaaaatcaccggtgcaaaaggttggtctaccttttgcgattttccttacctgttccaacaacatgaacgaagattgtcgtcttgcttctgttgcttcatgatccgtatgcgaattaaacacatagaatttcttcccagtccggaggtctttaaaatatccccaagtgcaaatccgacgacagcgtgctccccaaccataagaaggtatatccggagtttccgaataccagaaatcaccatgtttcaacaccttaaagcgatcttttttatagtaaatggcacaatgttctcctttattatccccgtcacggtcacgaccgatataagaatattcgttcagaatcatcatatcctttaattgagaggtacgcccttcctgtatggcaaacatatcgaatttattccgtcgcacaacatctaccaatgcgttcagacggacttcccaagccttatcccccttgtctcctttggtacggatgttataagatgcaaggcgaataatatcttctggtttcgttttgtctaagttgaaagattttgccggaagacctccggcaaaaaataaaatcaaaagtagaaaataatatttcttatttatagaacacttcatattacaaatcattaaatatcaatttatttactccatttaaataccggatagccgttgcctccttctttccaaagagaagaatcccagtttgtgacagtgtttttcagctcgttagcagatttagctactccctgaaaactactaccggacggtgatgtctcatctgatacggtaaatatagtttctcctgctttcagaatcataccgtcataagcatagcagttttcagcagtaacattattgttatgtcctcccactatacgtcctatttttgcctggtttgaattgtttaacaaggtattactccatgccacacaattcttgatatttagtgttccgctatccatattaccgactatacctccaacccagccgcctttagtagcactgatgtcaccacttacataacaattttcaatatatgaagtcgtgttgccagcatggaaccttccgataattccacctgctttgccgttatcagcatttatctgatcaataatagtagcagtggtatagcagttctcaatacgtccattaccgccgaagataccaccaattccgcctgctgctcccgaccctttcagtattccggtagtataacagttaatgattttacctgtgaatcctaccgcaccgctatttaatcctacataaccggctataataccgataccttggttagtagatgagatatttgcatcgacaaatcctacattcttacattctccacacaatacgccaaagaaactgggataagaaccggagtcacaagtcagatttctaattacatgattgcgtccatcaaaaattatccatttctcgtacggaccatctccatttaaaggcgtccacttgatcccctgcatatcaatatccgcactcaaaacaaagtaggtcgtttgttttccaataaggactttgctcatgttctgaatatgggtggtattagcaatcacataaggattattttgagtcccgtctccactagcaaaatcaccttctggttcattgtcatgtcctccataactagcataatctcctctatccagttgccactccaaaatagggaatcccatatctatattcccaacattatgccatggagtcccccaattggcaattctattctgcaaagtcaggacactttcgcctactccatcatattttcctgccgaaacggaacctgcattatcctccggagcaaatcctgtacaaatcatatcctcccatgcataacattcagatgcgacaggatccgcctgatgcccactttcaccttgagacaaaactccactaatacgtcctgatttggcagcgggtcccgttattttccagttccaggcaacacaggcagttatttttgctccttcggaaggaagggcagcaataccacccactgaattggcaccaattaatacacctgtagagtagcaatacgacacttcgctgttttcatacatagaacctacaatacctccacattcatctcctgtagatataacctctgctgtagaataacagtttttgatataacaaatctgtcctccatacggtctacccatacgggaagctattccaccagcatactttcctttcacttttccggagacgtaacagttttccacctgccctgtcttctctacagcgttcggagctttcactccgatataaccgccgataacccctgccccactattagtagctgcttctacatgggcattatagaaaccgacatttttacaagtcccggccaaaataccaaaaaaactagcatacgctttgtctgtacaggtgaaattctttataatatggttatttccatcaaaatagatataatagtcaccgtttgagttcaatggttcccaattagatacagacttcatatcaatatcagcccccaactgaaagtaaatcatctttcctttcaccaaggcttcactcatattctgaatctgtatcacatccataacgaggtagggtttgttcattgttccataacctttttcaaaaagcccgcctgctccgtcaccctcatctccgtcatctatgtctgtgtttctatccggcggaatacggctataggaatccatcggattaaaatcagagcatgagaaagataaaacagccatccataaaatggtccaatatctcattaccgaatatgtacttatatgataaaatttgtttttcataatcttcatttttattttagatttctactacaatcaccataggataatgatcggataaagaactgacaatagtgcgggtagaaagcaccgtagcatgtttcacaaaaataaaatcaattctggtctttttagaaggaaatgtaaaaagagcaccatgctgaatggttgcttcccgatacgcatctttcaatataccactttggcaaatcgtagtggctatttcgggagcatcaggagtcgcattaaagtcgccggtacaaaatgcgggagtattgtcttttgctttatcggaaactgcatccaccagcatttgacatgcatgttttctggcattatcagccaaaggcatgtgagtttcaaaaagataaaattctttttgagtcttgctatccttgaattttccccatacacagaaacgtttgaaatttgtttcatcccatccgttggaaggaatttccggagtttcggaaaaccagaaacgtccggcatccagtaatgtgtagcggctcttcttatataaaatgccactcatctctcctgccttattatcgtcatttccagtgtcacgaccataagcgagaatctgataatcactcgcaagttgagttcctaagtaggaacgttgttcccaactggcttcttcgaatccacaaatctcaaaatcgtagtctctgattaattgtgccacacgttcccgtcggttagtccatcctgtaccagtctccacctgtaagttataagttgctacacgcatggacgtttcagtcacggggtcttcgtcttcctcgccatctcctgtatcccacgtgaaatcaggatagtacaatgaattgtctttattatcttcacaactgctggcgaaaacagagaatatgaaggtaatcaatgtgtatattactatttttttcataaatctattatttatatcttttatacttgttattcattccatcccggattctgggttacgacaccattagataaggttatttcctgtcttggtatcggatatagataatcacggttctcattccaggtacggtcgatccaactgtaacacaataaattgccataattaccttctgtcaatgaggtgccgcttccatcggaagccaattttacatacgtcacacttccaacattgggttgcgaagatgtggtgtagaaacagacatcatttgttccgtctccatcgatatcatacgctttattgatagctgtagcaggaagataaaatcctttaaaggattgggccatacattgcccctctttccagcgcatcaaatcataataacggaagccttccatgaccaactctatcgcacgttcccggcggatttccagaatcacccctttattatctcctgtgatattcacataaccggtttccggagcacacatataagggtccggagaaaggtttgctgcgttcatattcagttttcccgtaactcctgcacgtgtccgcaatttgtttaccgtattgtcgatatcagtttgcgtcagtgtgcctaattctgcctttgcttcggcatagttcaaataaacttctgccaatctgaacagaggaaggtcattgcttgaatcacctgtatagctcatattatcatttgcatatttcagcaagtggtatccggtcatcgtgacattcatatttatatttgaagtacggattgtttgcgctaaacgcggatcacgattgactatttcatccttgaactccattgttgcataattgggttggtcggtgaaacggttgccattcttcattaaataataattgaccagttttttcgaaagtccgggacggcctaatgtcggagaattctcaaatgcctgtactttatgaaccagactcaaatcattattataatcccttgccaatatgatttccgcatcaatcgcattctctgatttaaagagattacgataggactgtgagccggattgatacaatgaatatcctccggaagcagtcataatttcattagaggcacttacacagtcattcaagtatttctcataatcacccaatccatgatatttacgataagtaccttcaaataatcctacacgtgacttcaatgcctgggcagtccaccaggttacacgataaagttcttttgtccggttggtttctttaaaaacctctatggcaaaattaagatcttccattatctttcccatcacaaattcgcgtgaatccctggctttgtataaatcggcatcatccgagccgagtactttatcgtaccaaggtacatctccaaaacgtttcaccttttcaaaatagaaataagcgcggaagaagcgtgccagggcttcatatttgtcgcgcactttctggtctttacagtttcccagattatccaataaaaaattaattgatcgcagtgcactccaactccatcctccacccgtttccggaatgacacgttgtccactcacttcatcgtccaaaggtgatacgatcaacacatcagcattatccttgtaaatatcgccatcacccgggaagttattcgaatagaattgattactgtataattgtaattgctcttcattcgtaaaataatccttagtcgtcaagcgatctttcggatttatatccaatatgctttcacaagaagcaaataacaacgacagaccaacagtcgcccacaatgtatatttcattattttcatactatattcctttatattcgttattatcagaatgttatatctacaccaaaagagtatgtctttgcccagggataaatattcgcgtcacttttacttgttttccagctgttacttgccgatgcttgttccggatcaatataatcggaatgtagcttagtgaatgtcagcaagttctcaccactaaagtaaacacgtattttctcgaaacctattttagaaagccatttatccggcaatgtgtagccaatagaaagattcttcaatcggcaataagccaagttctgcaaatatttagtattaaccactgctaattcacgattactaccgagagccacatatcctctgggacgtgggaaataagcatctgtattttcttcactccatacctgactcataaagtcggaaggaataaaactagcgtatggtcgggaataaggtccccaaaacatggacgtttcagcaccaggataccagttttgtttgccaatgccttgaaaaagaactgaaaaatcaatcccataccagtctgcggagattccgaaattataattatagcgcggcaatgagttaccgatcactttcatgtcttttcggtcattagccgatgttgtctgctcaatcttgttgttaccatccaaatcgacaaatttgaggtcaccggcatgaagtccattatccaaagcgcttgcattaatcatttggttaacgaacgattggtccactttataattccttgcttcttcatccgttttaaaataaccgtctactacgtatccccatatttcgcccaactgctgtccttcgtaaggatcagtcagcgtccggttgggattatcatattttgtcactttggaggtgttatctccgataccagccattatccggtagttgaaaggcttgcttgccaaagtaaaactatctccccaagtaatagatgcttcccaccctttcgtacgcaagtctgccacattcattctgggagaagaggcaccatatacgccaggcaaagtctttcctgccatcaacatatctttggtatcacgaatatatgcatcaaaagatacattcaaacggttattaagaaaacccaagtccaaacctatattttttgtgattacagtttcccaggtcaaatcggtagagttcggagctgactcataggcataatcgcctttcgtagtatctccgaaagcatagttcattaccgctccggtattaatcagttgcagatagtcataataacctactgttttctgatttcccaatgatccgtaagacagtcttagttttagattgcttacatagtttttggcttgtgtaaagaaggcttcttcactgacacgccatccggcagagaatgacgggaagaaaccgaaacgatgtcctcgacggaaacgggaactaccgtcataacgtccgctggcttcaaatagatagcggtctttatatccgtaattcaaacgatagaaaaaaccaagaatagcatattcctcttgtcctccggttatggatatatcatcaccttttgccaggttaaaatcatcgagagattcagagagtaacccgttacgtttcattcccagtttcttgaaatacttataatcatagttacctcccacaatgacctttacagaatgtgcatttgcgaaggtattgtcatacgtcccgtataagttgaaagtctggcgtatctggttgttttgtatttccgataaataatttcctctggtacgtccgttatccattgtgattgtttctcccggatttctggagtataacacatctacggaacgattcaaattctgctggttgtaatgcgcccagctgtaatttgcacgaacctcaaaatgtttgatgggtttcaatacggcctcgaacgtagttacaaactcatattcacgatcccggttatggtggccgccattcaataatacggcactaacaccatctgccacttctcctgtgtctgtcagacctgttctgtaaaccagggttccatccggatgcatcggcacaatacttgccaaagcatgccgcccggctctgctgaaaacatcatttactcccgatagccccggataagtatattcagaatgataataagaggtattgttacttaattcaaaccaggaagtgatattagcgatgatttttgaacgaaaagtatatttcttaaagcggtctgaatctattctgataattcctttctgattgtagtagttacctgatagcatgtactttactttttcggttcctcccgaaaccgtcaagttatgttcccaagtggggcgggtattatcaaacaaacaattataccagtcaaagttgccgtaatatttatattctccatttttttctaccacccatggacgggaaggatcttccactttatcattacggcgaatccataattcatggtaatcttcttgggtataatgtgtataagggacgccctggtatgttttgtagaacatatcattaataccggccgaataataaccacgtgtctcaaagtccgtagaagttgttgtatcaccaaaactgaaacgaccgttatagctgacattggtctttcctatctttccattcttggttgtaaccaaaataactccataagcagcacgggcaccatatacggcagcagccgaagcatcctttaaaacactgatggattctacgtcattggggtttaccttatttatatctccctcgattccatcaataatagtcagaggtgctgcatccgcactaatggagttgactccacggatattgaagcttcccccttgtccgggacgtcccgaactaaagtttacgttcatattcggtacagaaccttgcagaagctgtgataagttagcagcagaacgggtcgtcagttcatcacccgaaacgatagcaacggcaccagtcaggtttactttcttttgcgtaccatatcccaccactaccacttcttccagtgtcttactatcttcgcggagaactacttgggacagatttctgctggtagcagcgtaattaaccgtaatatatccgatgtatgatactgtaatcgtactgttttcgggaacattagccaaagtataacgtccgtctacattcgttattgtacccaaagagctgccttgtaccatcacactggcgccaataatcggctctcctttttcatcgactacccgaccggatatatttcttttgttcgcattactggtttgttgttcagaatccgtaactttctccttcaaataaatttttgtttttccgatctcatagtttacgttagtaccgagaaacaaatcattcagaactttagatagttcctgattctttgcttctaccgtcactattcgatccggattgacgatcgtacggctataagccaccgtaagaccagtttgctgtgtaatagcagagaatactttctccagctttacttgtttaagattcattgtcaccttttgggcagaagcggaaacgcttatgattattcccagcaacaatacgagcagaactttgtgtttcatactacttgctttgattaaagttaaacttagatttaaaatctcatttatgcttagtagacacacaagtcaaaaaagcgggtgagagaaaaaagagtttttttgcataagcctaatttatttcataacattcttattctaaaacagtaaaggctgcgtatatacacagcctgtcctcattctattatcctatccagtatattttacttctttccgtcctgtttcattcggactgtcacttctttccggacttcatcatattcaaattttaccggcgcaatcttttccaaatcctgaagcactttctccagtatcgtattatccgaggtcaacgtatatacatatttcgatgcctgctcatcctctatcttaaagtttacattataccagcggttcaaaaccttgactacttctgtcagcggagtatctttaaaagaaatcacattatctttccacattgagacttgttttgaatgatcgtttttgattatccggcactggtcactttctttattatatatcagtttctcgcccggcagtaacgggtattcttttgcagaggagagagtcaggtttacatgtccttcatccagacagatcacaatgtctttattctccgggtaggcttgtacatcaaaagaagtacccagtacatgaacggaaggtccgttcagattaacaataaacggacgttttttattcttggctaccacgaaataggcttctcccaccaggaaaatttcccgcttactcaatccgaactttttaggatacttcaaccaggaatctgaattgatataaactcgtgtcccgtcttgaaacatcatctgtatccgctctcctttggcaacacgaatttcctcatactccgtagtgccgaataaatccactcgggaattgatctgtaaataaagacctatcaggaaaataacgggaatcaagattgcagccacacggaagcagatacgtttgatctgtttgcgtgatatgttcttttgaatctgatggtacatcttttctgaaagtatagtatggtccacatatatttctgccgtttcggcttttaaatattctgcctcccgagtcatcacagcatccaggtaagtgttcccttcttctgtggcaaaccattccgccacaaattttgcatcctccggtgtagcaactccggcaagcacttcttctattagtttatcagtgggtcgattcattctctttttatcttaaatagtggacacttaaatatgtcattagtgtgacaaaagtaacaattattagcattttacttaaatgaatacgtagcattttcaatgcttccgtataatgcgttttgactgtattaacagacagattcatccgttcggctatttcctgattcgttagttcctctttcactttcatcaaacaaatactgcgtttctgtggcggaagcatatctaccgctttataaaaagaggccatcaattctttcttctccagattttctatcagattatcttcgtagacaggcgtcgattgggctatctcatagttcttgctgattgcactattctcattacgaatcagatttaagacatgatttttcgtcatagtgaacagatagtttttaaggctgattcctacatgtagttccgacctaaattcccataaacgggcaaagacatgttgcactacatcttctgccatgtctgcattcattaaataacggtaagctaatacatatagcagcttatgatatctgtcataagcctgtgtaaaagctcctttatctcctttttctatgaaggaaaagagcttctcgtcatccgtattagtgtattgagctgatttatctaacattccttggactttgtttaatcgtttttccaaaagaacaaaagacatattacaattatgtgtctttcacaaaacaaaagtagtaaaatttagaaaaggcaatgcatattcctataaaaaaagtccctgattaacaatctccactataaaagaggatcgttaatcaaggactactccactaactaattaacaaatgaattataaatgataggtaacaattctttcttcgggtgaatcgatccagagccgccatactccttccgacactttctccggtgttccgatatttgctttgggggaacgacggcttttgattgtcagatagcctttcccttctgttgctttcactttcatcgttttgctgttcatatagacatggatattgccattcggtgtgggtacagtgccttccatccatttcaatcctcccaatacaggagcaatagcaaactctttatatccttcttttacaggtttcactcccagataatatttgcccaacaggtagataggactcgctccccaggcatggcacaaactctttccgtatggacggccatacatggcaagatgttgcgttccggtttcttccgggttatatttttcccagaaggaggtagctccttccttcaacattcctccccaataggctttcatttctttcattacagcatcttgttcgccaagagcacaaagggcttccagttcgtaaaaacgcatatagggagttgttattttcagaatactgtcattcagaagaacagagttcttgatggcttgctgcttgtctgcattcaaatattgaaagaatacagaaaacatatttgcatagcgggtgactgcatcactttgctgaccgttgacgcagttatgtacaaatgcctgtttctcgttattccagaaggcaggttctaactttgctttcaaagcagcagccagtttctcgtatttctgtttgccattggcatctccaaccagttccgcacacaaagccattgtttccagacttctgcaaaataaaacttgctcaaaagaaagttccccttttttatccagatagccgtccgcccagtccacaaatacccagtcaccggtcataccttctaccatgccattcttattggtacgtcccaacacataatccatcattgtttgcatacgtggatatagttggttgacaaaatggcggtcgccactatacatataatagtcatatacactaagaaaccaatagaaagtatagtccatgattgtattactgtggctggttacaggatccttgccacgaagcaaccagattgtacgtttgacggattcgttatcaaagaaaagataataattcatcaaataactttggatagcatcgccactccatacccaacggtcacgtttgataccatcaatgaagaattcgcgggtagtgagatgcatggtgtatgcgccaacttcccaaatacgattcagttcttcatcattgcaacggaaatttccgcggtattcttcaggaagatattcatattgcatggagacttctccaatctgtacacccggctcgtgagttacatagacatagcggaaggctttactgttctccaatgtatattcgttttcagaattactcaagggagaagtgctgcggatagcaaggtcggtcacttgtcccggttcgagcaagagtttgtccaatgtttcgcaatatgctttatcttttgcttcttccgggctttcaccataataaatttctatttttccttttccggaaagattcttcaatgtgatgaatccgaatgtttcttttccaaaatcataaagaatacctccttcgaactgttctgacttcgtaacaggttgctgcggttcacgcatcagactgaattgggaaggacgttgggcagctccgtcaaagttccagcatccggcatccatatagatagtggcagatgtgtcactggcttttccgctctcgtcaatccattctttatcttcgtaagtcacacgccaggaagagtctgaattcactgtttttcccttcacataaatagtgggaggagttgcctgattccagactttaatgttcagattatgttttccggccggaagcaacatggtttccggcataccgaactggagctttccatccagtttgacgttgtactttccttcggcagcaataaagatttcttccggctcggaaagattcagttgcttgctgaattctacgacaacataatgactatccgttttccaaaaaggaggaaaaaatgcacctcgttccgtacgacggttattcatttgatttcccagccagatttcgtagtctcccggataccatatccaggtctgggcaaatgtgctgcttgccaaagacaaggcactaagcaatatcatatatttctttttcatttttctttctattactaacaaactgaatcgtaagaaataattcgttccacagtggttgacgtttagttccacatctgtttccctttagttctacaattgttttcctttagttccatatctgtggaacgaatcacgtattacagttaaatgacttgtcaatacctactggatatttagtaaatccttatatcctgcttccagtcccgcacgttcatgaacatcattatccaccttcgggccattgttctcccatacatttcccgggccattggcattttgcagatacttctctccttctgtccaattatcacgtacagtaataaaggaagaaccttcatccgtataaagatagaaccagtgattaggatcgtgtacataccccggtttataaatactatgcacgcaattctccgttacataacttttcggctgcgaaccgagtgtgtaaatacctgccacatcatacatgtgtttcgcataatgatgaatcagattggcatgtactctgttattacgcatacaattcacagtttgcgtccatccccaaccaagactgatgccactataaggcacttcactgatttcattatgttcgatattgacgtcccctacatatcccgcagcaatggcaaggcatccccaatcttcattgcctatttccgtgaaatagcaattattgatttgttgctgtgtgcatacttcccgacgatcagcagggtcgtatggcaaatgcgtttcatgggcagccggagaaaaactgccgactaacagaccatttccggcaatatcgcggaagagacagccacgaacaacaccgccttgcaccgcttcttcataatccaatccggtcgagcctaaatgctcgaaccggcaacgctcgaaatcaatctgccttgcagcaaccacacgaacagcagctgcgggacgtcccaaccatccttggttatccaacagatgattcaagtagttccgttgcattttcggatcaatccggtaaccatctgtcagatacatacctgcctgaagaggtacatgtcctttttctgacggacgcatccacgtagtataggaaaaagtaattttctcaaaacgaatatgacacacaggacgatctaaagttccttccacccgtactaatgtctcaacggcaggcacgatcacttccgcctcctgcatcttctctccttcccgtggataataatatactttacgggcatctatatcatgataccattctccgggtacatcctgcaattcgcgggcatttgtcagatagaaagcagaattatgtccgtccgtcgtcaccatcggacgcggccagggatgctcaaactgaatccggctttccggttgatgaaaacgtattgccgcactatctccctgcacttcaactgaacgaatccgaagattggcaacacaccacatctgatgtaataccatctcggcatatttagctttcaaattccctttattatcaataagtctgcgaatggaaactgcaggtacataaagaatttcattcttctcatccacactgcaaatgcgattcatcttttcgaaatcttccacatcacgggcacgaactgccttttttccattcacccacaactggcggaaatccaatggacgtccattaaatgccgggacatctgctacccaaactttcccttgcttcttccagccatttatgctgattcctccactcaatatcaccttttcatcgcctaccgaacgaatgattgtgggcgattctttggttccgctatcttccggacggataaaaaccggttcatggaaggcatacgttccaccttccacatagattgtgattccaccttgaatacggttatcctctgtcctgcgccattctcgtgcttgtcgcaaggcagaagtcagcgtggctttaggagattgacgagttccgtcgttgaagtcactacccttgggagaaatccatatctcaccggccaatagccagtgactgcacaagatacatatagccgttacaaataactttttcatgatttttttcatttctgtatactaaacaatccggattatctggcaagaggcatccatacagtcatttctccctttcctctgtttccccaggcataataaggaatcaaacggatatttactgtcttttcagcctgaacaaccggccggtaaagcactccttcccacgaagttgcagatgccagacgtgccattccttcaagtgcaacaatcggactgccttcaattgtgatttttttcggagttagttttatatcagcgggaatcaatacgttatcaatcttttccccgtttgcaatatccatactttccagacagtaaaccaacggtccgcgcttcacaaccacctgattacgaatctcctctgctaacggatgagcttcgagcaaacggacaggcatatccatcaccagctccactacatcccccttcttccatgtacgatttacttccgcatacgaatttgcctttgcattggtttgcagcggctgtccattcactgtgagcgtagccttttcgcaccattcaggaatacgtaagaagagcgagaaagtacccgccttacgaggaactctatctaacgttacacgtacctttccttcccagggataatccgtctcttgtgttaatgccagttctcctttgtctttccaagtcgtagtcagcgtatttgcaccatacaagttacagtaaatgccttccggactcaatgtgtaggcgtaattctgtgcctgacacaatgtacgcaatgtattcggcgggcagcagaaacaactgatatattccgtccgttctttcggccagcgaagcgtgtaaggaagatcggcactgatacgaagcggattcgtgtagaaatacttctttccatccagactaataccgctcaatacactattataaagacaagtctccacaagatcggcatatttcgcatcccctgtcacttccagcatccgccagttgaacaacatattaccgatattagcacacgtttcattgtgagcagtgctattcggcagctgataaggacgtccataactctgatgcactttctgaatactatccggctcataacacgttccatcgggcgatgtaccatcataaagagcaccgcaagcaccggtcacatacattttccgggtcacgatatcattccagatactagtcagattcttcattaattgctgctcaccggtttctgcatatacatccgctactccggcatacagatagttggcacgtaccgcatgtcccatcgcacgatattgatcgcggaaaggaatacggtcctgattatcgtccgtaccgttctccaccatgccacggatatcaatcagattctttgaaagttccagataacggggatttccggtagcccggtacatttcaactacccccatataatgagagggacaaatagcattacgagccagttcggcagaagccgtttcataaaaatgacagaggaaatccgtcgctttcacagcagcatcaaaaagagtagtttttccggtggcacgacgatgcacaatacccgccatcatcaagtgtcccagattataagtctcaaagttcaaccgattcgcaaaagctcctttttcatcctcgtcacctactttcgttccgatgactgtttgtttatgctgatcccctaatgcatgggagtcaatacctttattcagttcttcgataacaacaggcgtatgtatataaccgtctgcacgttgggcttttacgacacaagtaataaagttatccattaacttatccagttccggatctttattgacagcatagacagaagccacaccctccatccatttatacatatctccgtcatggaacggaggtccccaatgttcacccttacacacaccagcggcaatctcaaaattacggaaaccgtgagagatctccggcgtgttccaagtgttccacatactttgcagggaagtccggctaaatacctgaaagcgatctccccagaatccatctgtccaatgtacggcactgattccggtattcgccatcttcgcaaaacggctctgactcatatccgtcaatccattgctttgcgcaagtgctcccgtaacggaggcggaagctaaaagaagtaacagttttatctgtttcattaatatggataatttaaaatttacacaatatctttataaaaagacgtgattatccgtattttgtactcaataaaacgaaagcgaagattgctaagcaaccctcgctttcagtaaaaagatctgtattaatctttatttcttatttatcaggtgtataattcaactccgcctttctcgcctgcgaatgttgaaattgtcgtgcaaccttatactcatgtccgtcttttaataaataactccctgtctgcttaaaccaaaaaccgacattcgcatctatacattgctgccggatatccaatacccactcgtaatcacatacccggacttctttgcctgactctcctcctgccactacctgttccacccactctcccagctcacctctgaaatcaatccgactaagaagcggctcgcagataatgattttatgtttaatagggatttctttataaataggtaaacgataatccactctatcttggttctccatcgtgcagcagatggtcacattgtcatagccatctccccaatcgggaggcagacactgttgcaaccggtctatccgtttagtgataaagaggaaacgaagatcctgccgtatccgcatcatctcccacgcttcggcacgccattcatccgcatcttcaatgagaaaatctgaagtaaaacaagtatatactaaatttcccgaaggtatcttatacgtaccattctttttacgctgcaagggtaaatcgaacttttctgtctttgccaccaccgaactgtcttttccatatttaccatccgtccggtatacataacaatgacggcagccttcacttaatttgtgacagccgtgccatagattccacattgaagctttttcacccatcttcttttttcttcaaaaatatatttaatattacatatacataactataaaaagagtgcaccttattctttatcagaaaaaaggtgcaccaaaacacaaacaaaacaaacaatagagcgaccttcacaggcagccgatccacgagggatctttatcttagtcagcccatcttgatgatgatagcttcactcatagcgatactcctactgctgataacaatgcaggcaaaaagtattccatgtattgccttacatgaatccggttttccatttcctcccaaaattctaattgcttataacgggtaaagtagcacccaaaaatcataaaagaatgtttttttatcgagaagacattttgctaatcgactattatatataatcattaatccctaatattgtttgttagttaccttctgcaaaggtccgtataatcacgaatatggcaaattgtattcatgtttaagagaacaatatctgtttacaaacaagactaatagctaatattttaaaatagcctgtttcagtatatgcaaaattcaaactcaaaagctaccacttttacgttattcgcacatttagggctatacaattccaattatcacaatagaaaaattcgccctcattctcattgtatatcccgatgatgaatatgaatattattgaacaatcactccattaagcccgatatacctctacaaagatagtattattctatatatttctatgcaaatcctcaaaaaagaattctcctctttttataaataaagtaaagtaacatcaatgccgatatactaattattagcatccaacttatatttttcctataatataagctattctcttcctcctcacaaaccactttatgatgattcgtgtcgatgaaagatgatatttgagtatcttctttctcatctatcctctctttcttttcaaaaaccttattcaccgtctttctgctacctgaaataaaacaagtggaagagaaatcccctgtcgcagtatctttccccaatactaccaatatttgttcggtagactcctccatccgttccagcatcttcctttcctgattaacatcatacgaagccacatgggaagaatgcccggaagaacttgaatccatctgcacctcactgctcctactgataacttccttcttagtcctacatcccgaaagcacccccggaagaacgaaccccaataataaaacaaacagcagctctctcccactcttcataaactccctcacatcaaaacaaggacacgctttcacatattcataaggttcgatcaccccgtctccattcaaatccggcgaagtatcccggtgtcccaatacctgaagaatagtatattcccgttgcaaatccattattacttgataaagcacccgtttttgagcatttgtccgagtatctgccggatgtccgttctcatccaatcccccgatataacagagcccgatacttcgctcattccaacctttgcaatgtgctccaggcaaatcaatttcccttcctttctccagtcttccgtccagacggataacataatgatatccgatgccgttgaacccacgttcccggtgccaacggtcaatatctgcggcggtaaagtcctgtccggcttttgttgccgagcaatgcactataatagaatctatctttctcatgacattttatttttatcaactaacctcattaatattccgaaggaggaatgcgcttcacacaccctctgatctcacactttttcacctccgactctttctgtgccaactccacctcatggcatttatgtatccagtcgatcttctcttcctgctccttgcgaagctcgatataaagcccgtctattttctcgtcccgctgtgccaggcgatcttccagccaatccacctttttacgacgattttcttcttccagactgctcacgtctgcctcttctttccgtgcatccgttttccggcaagagatatatctcaccatccatttcaccgcttccaaaccacccatagcagtaataaaagcaaggattgtagttatttgcatattgatctatttatgtagttataaagaaagaatgaggccgaagccccattccatacaaaatcgctaattcccgactttccgtttatcaagctgccggatcgggtgcttcaccattacctcctgcacctccgtcaggatccggtgcttcgcctccttcgcctgaatcaccgtcgatgatacttgagtcgttgatatgatccaaatccttaaacttcaatccatccgaacgcgtcgaagttcccgtaaagagacggatatccgaattcgcacgaaaacaaacccgcagaccactgatgtcggatacagtaaaattttccgccttttccgttcctttgctttgagctgaaaggaaaaagtaacccaatcccttaatgttcactgaacggcctgaaagtaatgtcttacgtagaagtgtacgaaaatctttcaatacactaattgtttcaccctcacttacaccggaagtagaagagatttcttttgcaaactcatccagtgtagcgctcgtatcatattgataagaaatcaccggatacactttctttcctgcctctttgtttgtcggatcacacagacgttgaactcttttaaatctaattgccataatacttttctttttttaaatgaatactgtttaataattacttcgctaacgttaacaatgcaaagatgcgacatattcaacggacatgaaacgacaagcgattatcggctatacagcatattagaggagcctttttccttaaaaaaggaagtgaaatcaaataaaaaacgacaaaaaaggttagtcaggaagaaacaaaaacaaataaatatcacatttattcaattcaatagatatattttcatttataacatataaaaaggtgtaggaattatagggcaaatcttatcagacacattgtcctacttgataccgtatttcctacacctaaagaaagaataccctgtttttatctattcagaagtctcatcaataatcattttactatctatttgtgtcttcatttattatagtaatcgtttttgagaatatagaatctcctcctgcgtcgtggactccataaacagccatagaaccacaatttatgccattcattctttttacagtaaacttttggctgccagtttctattcccacaactgataccctgggttccaagacagaacatccatctggcaatacaaaatttattatgatcttataatccacattatcttctgacaatttccatacaggcatttcctttatagtctggagtacttctttatctaaatccatgcaaagccctttaataatccggctatttattattttcttacttttggatatagtaaagcctgctatgatctctccttgtattcccatctcaacagcttttgactgataatctatattttctttgagaaaagaaaatatactgtgtagtcctgttgaggagcaaaaagcatcgcaacctatagaatccatttgtatttgagaaataacaatcgtatcatttcttgttgcatctaatgttgtgactgttttaaatctagacctgtcatccaagtcctgtgctttaaccgaagcattgactactatcattaggataataaacgaaaataaccatgagtgtaaattttctaccctactttttaaagattgttttttgtaaatcataagaatgtttttaatgttgatacattgagaatatttaaaatctgtgctatagcctattggattaacctatgtctgcatacataatttattcattagtgtaggtaaataagagtcgctaattggtattaaagccccatcaatacggattcttttccgttcgatataattaatatgagataacgaaacaatataagaacggtgcacacgacaaaaattatttccgctaagacattcttcaaaacgttttagacttacttgcgaaagtatgggctttccatctgtgcgatgcacctttacgtagtctcctccatatccttccatatagagaatatcttcctgacgaagtctaacaatccgagggccctcacgaagaaagataggctgtccagcctgtttgtcacacaacagtttgttgacttccattaagtcttgggtaattttctccagatactccatcaaatcattgagcgtggaaacatccccatcgaaagtaatacatttcagcataacatctcgttttaattgtagttatctaccacaaattaaaagaaaacatcagtaaactaaagttaaacaccggcaaacggggattctttgcaggtgagacagacagcaagcaaaggtgaacagattcaaccctcttcctgcataagccactttttgaataatggagtctttaccttacttataataatacgttctggaataggcaaaagtaaattcacggaaagtcggttacctaaccaaagatctatatctttaatagacttacgggatacaataaattggcggttagcacgaaaaaaaagctgtttatctagttgctcgccaagtgcatcaagcgtccggtctacaggatgccttttaccatcaaaagtataagcagtaaccttctcctgaacagtataaaaatagtaaatatcatctaccgagagtggataaaatttgtcagcaagcataatcagcaacttctttacttcattcctgtttttaatagcagtattagtttgcaggatatgttcctcacgctccaacggattaaaaagaaggaatttattcaaagcatgctccaacgttttttgtgtaacaggttttaatagataatcaatgctactcacctgaaaagcttgtaaagcatattcatcataagcagtagtaaataccacaggagccgctatatctactttttcaaagattttgaaggccaatccgtctgccagatgaatatccataaaaataatatccggttgtgatgaactccgaaaccattcgatactatcttcaatactttccagttcagcaaccacttcaatgtcaactaccgaattgtggcgtaaaatagccttcagactgctaactgctgctgtttcatcttcaataataatcgctttcatatattatcccaatacgtttaataaaggaagaaaaactttaaaatatccattagatttttctatatagatattctccccagtcaacatcagataacgtccctgaagattctttaatcctatcccactacaaacataatcttccattttaggttgaataggatttgatactaccaataaactttctgatactgtatatatctcgattcgcaaagggtgttgcatactgataatattatgtttaactgcattctcgatcaatggaagtagacttaggataggcagttttttcggtagacagggttctgcgacctgaattgagaaaaacaatttattttcatatcgtacactaagtagataagtatatgcatttacaaaattcaattcttcattaagagtcactaacgttttatgatcactctgcaaaatataccggaaaacattagatagcccttccaaatactcaagtggtttttcctgttctcctgtccggatcagcgaatcaagtccgtttaatgaattaaagaaaaaatgtggattaatctgccccatcaacgcgttatatgaattttgcaatttctcaacttttatcttctcatactccaacttcatttcttgtttcttatcaagcagatggagcaaaaatatacttaacataataatcaacaaaacaaaaatatgttctattaataaaggatatgaatcagcagcagaaaagatagtacttattcccaatcggatctgttcaggagtaacaatggaatctgtggctatattcagcgttttagtcgaaacttctgttattgaaataaaaccatctgtgcacttgtgaggatggggcactgttatattgcatatcctttccataagtaatttatgtaaaataggatatattttatataatccgaaagcaataaataaaactactcccatcgcaaatcctattattttcacttccttacctcgaaaaaacttatttccccatttatacatccatctataaaaaataaataatatgaaagaaaaaaagaagaaccagaatatggaaaaccaaaaattacatttttccgtttcacacataagaacggatactttcgaatccatcatcaaatcatagtgccgcatcaagagtgtaaaattggcaaaaagagaaagaatcactgatatagtgaatccaataaataattcgttctttgtcaatcgcaacatagtcctcttttattttgttaaccccacaaaaataatcaatccagcaactctatctcaaataagccgatgaaacggacaaaacagtcggtgaaccgccatctttttatagataaatgaaaattcaggtggtatattgcatcctcttttcataaataaacctcatcgacttattttaattttccccgataaaagatttcacccaaagtaagagaaagtgtagcacctataacgtcacgatttaatatctcttttttcagacgtaaccggtcataaaaaataccaatattaattcttcctctaaatacgggcaatcctagtccggcattaaaccgtaaagacactccggaacttccattgatcctcatataagagttagacaaatcaattccggctttataagatacttgtttccaaaagccatcagaagaataaccgttaggaaaataacaaatgccgacacgacattcattcacgtcttgaaattcaattcgactgtctacagacgttagagaagtatattgctgaaaagtataatccaatgcataagtccattttttatattgtaaagaaccgcctattccaaaatattgaggtaagctttgcttctgacttctttgcttcttcttattttgtgttttgtcatttacaatgtatttctcattagtgacatccattttctggcgatggccgtaaacaacccctagtgtataagacaaatcatgattcaatgcatagtgatattgaactcccccatttgtataaagtgtccttgcgtgcatcttcttatcaacagccacgtcattttgttgctctgacaatacaatgttaccaaacaaataactaacatttattcctatagaccaatattgggataacagataagcatttgaccaacttatttttgagattcctccacttccagtaaaagcgccaatattactctcatgaggatttccttctataggttgagaagattggaaataataaccaactgaactataaggagtcagacttactgctgtataccaccgtggaattacccgcccacccaatatcaaagcagaaaaacttccagtaaacgcccgattagagctgccttcagaagtgcacgattcatttttggcaaaaattgcaagttctgttagaagccgtttactgtctaaggctgtcaatcctgccggattttcaatgttcatcagtacattattcctcattccgtaagcaactccacccatacctgcattctgtccataaagtccgttttgcagttctccgatgccaaacatagaatatggcgatgaagtcattacgttttgtgtctgtgcctttagtgtcattaataaaagaagaatcaggcaattaatagctttcatatattttgtaatttaattgaagagttataggatgttgacctttagtatcactaaatgtcagatttctcaatgtcttggtataatcatcactattaaatactaattgaagattatgcttgtattttccagaagttcccaattcatctttcatgaattgcgtaacatcaaaataatagtatgtatttccaagaaatacatcatccttcactaatttccctccttgtacttgctttcccaaataatctttaacagcatcagtgactacattattttcgtctgctatatacaggaaaatgctatccggcaaggtattatatcctgaataagtaccatattcaggatagattctcaatcctgctttttctatatgcacatattcaccttgctccattatatcattaagataaggaaactcaaggcgggtataccatccgataccagcaaatagcactcctctgtttcctaattctgcagaaggtatctctacctttttccatggatatgtttccatgggagtatcatgtcggtcatgttgtaattgattgaattgtgttgctgtattcggtgaaaaaaccaatttctgatgattctcataaccactttcaatatgataatgtaatatcaaagctgacaatgaatctgctacctgaaaacctaataatgagtaactttgctgttcatcaggaatgataacaattcctttaaaatagtcttcaaaatgattcacggcaaccgactcatcatggttatggaatcgggtcagcaaatctttccctaacttatccggcaagcgtatctctagtttttcagaggttcgggggctaggtataaaagaataaacagtcaatggttcgggttcataagcaaatgaagagttattatacaaataaccattgtcattcaatacaactttttcagataacaaatgaatggaataccgttgctgttgagtagtatcaccaacaaaattcttattagtggaaagcaacaatatcaatgaatcaaactgcactgtcacatccgattccgttgaatattgaggacgcaaataagggatataactggcagcagaaatgctcccccataacggatgcatgtattttccagccagtacgacttgctttcctgaagtttctaaagagtcaattaagacagcagtcaccgtgatggaactcgtatccatacttatattacgtaaatcagaatcgactaatctatttccgaaagtattattttcatcataacacgatactatggagcaaaatattataaagtaacagcaaacaacaaccaacaatttatacatattgcatttttgactgcaaaagagaggataactcttcgtatatacaattttaacccgtcaatcaatctatatcttccggtaataaactatttgtaaaggtgaaataagtattaagtgctgtcaaatcattcgcctgccattacactgaattaacggcctaaatttatatacttaccgattctatttgcccaacatatgaaagccctgttcttttgtagccgtaaaataataatattatatatgatgaaacatttgaatttatttgtattcctgataactgtgatttctgttatcataatttcttgtagtagtgacgaggaagatgatttgatgggtaaatggtatcgtgtatccgattttgacggattagcacgcggagaagcaacctcttttacaattggtagtaaaggatatctgactggtggttatgatggtaaaaaacatctgaatgatctttgggaatatgatatggagcttgacttttggacacaaaaggcgtctttcccaggaacctctcgtagctctgctgctgcattttctgtcgaaaataaagggtatttcggcacaggctacaatgggaaagattactttaatgatttttgggaatataatccggatacaaatacatggaattctaaagcagattatccgggaagtgctcgtaatgatgccatagcatttggattatcggacaaaggatacttaggtagtggttacaatggaaattacttaaaagatttctatacttacaatccatctaccgactcttgggaacaaatagttagcctaggtggcagtaaacgtcgtggagcagcttgttttgttatagacaacattgcttatgtctgtgccggattcaataacggtgaatatgttaaagatttctggaaatacgatccagtccaaaaacgttggattcaacttcgtgatattgcagacacatcagacgcaacatacgataataagtataacagtatagtacgaatctatggagttgcttttgttattgacggacaaggttatctaacatgtggtggtactcccgatttgcgcactaatacatggaaatatactccagatacagatttatgggaagaggttgctaattttaaaggtgctccccgtactgcaacagcttctttctctaatggaaacaaaggttttattgttacaggtaggagcaataattatcgttttgatgatatttgggagcttcatccgtatgaatatgatgaatattaaaaccggaaactacatactttgggttagtctactatcactattgattatcattcttcttcatcagtcaattatagtaattgaggatgaagaagaatccaaagctagattagaaatatttcaatccccaaagggatggggatatcaaattattatgggacagaagattcttatatatcaaccgaccattccagctattgacactgttatgcctttccctgatgaaattagtacacggaagataggtatactggtcttaaaacgatttaacgaacatcgcaacttttctgtttcaaaggaggaagtttaccaacgtttaccttcatgttataatgtaatagtagagtgattttttagtcactaataatttcaaagcagaaactccaactaagatttacggagattcagaaaatgatatgttacaattttaattaatatatttgataaattcacatcaaaccttttttataaagataattcacttccacaaaatacgctctaaatcaattataaaataaaagaacgatatgggtgtgatcaaacataaataccatctatgctccaatggaacatagataatcaagccccatttacttattttactacacatgtaatttaacaagaaattctttcattattacaaattggggtgatgaacataacttcataacccgattttagaaagatcatttattcctttaaaaccaacgaggtgtttctcggtgtgcaacgggtcgttcctttaaaaggaacgacccgttggttttaaagcaaaaatcagttatataactacctaataaccaacatattgtatttgtttgtttcgagccactttccgaaagaaaattcacaacacaagcaaaaaggatgttagtgccaagcgtggctattcgttaataaatattttacaaattaaatcttctcatcaatggttacagttactttttcgatcaagccctacctggcggcttatatgtacgtgcgcttcaaaaatcatatcgactcgcctcccaacgtccctttatcttcttcctcacattcacctattcaccttctcgacacccaacctatttatcacttcctccatcagctctccgtcccccaccctccaaatgtgtcttggcacgaaaccggaaatataactttctcccttccccatccaagatatggcaaaaatccaaatatatacaattatataggtcacgacagcgtacttgttatagaaaaagaaatagaagtggaaatgaaagccgaactctacgaattccttctggaaaataaatactgccacggtatcatgttcaaaagatccatggaaactttcgtcgaacattataatatggtagagctagtggaagaagaaagtttgatgagggcgtttcagaggtggagaaagatggtaaaagaggagaagtaaatgaagtaccttaagctatattccaacatagctctttatgaatatatttcaatacaaagatttgaaaatcagatgtatcttcctttttcaagattaacagtttgctactcacttgagaagatagaacgagtagtataattatcattcatttaaacaacattacctatgaagaataaatatctatttccataatacagtttcatgttttctcatcaaatataaattcatattactaacaagtagaatatattgtgtgtcatattgatttttaagaaattatattttgttcagttcatacattgatagccttataaattgatgtctatttataaggtcattgatttacaattatatcagcaatcaatcaaaatacaaaacattttaaaatgtccgaaatatgaaactaaattaactaggaatactttaaaaaaataattatctttgtgcaatactgaataatttataaaatcgcaataatggaaaaagatataactcttgaatacgcggcttttttaagatcttttaaacgaaatattgatgtaccacattcgttccttttaggtgctggggcttctataagttcaggggtacaatctgcttatgattgtatttgggaatggaaaaaagatattttcttatcaaaaaatgtaaattcatcagaatattacaagaatttcaaggataatgctgttaggaaaagcattcagaagtggctagataatgaaggtggttatcctatattagattccccccaagagtatagtttttatgcagaaaatgcttatcctattgcagaagatagaagaaaatatttttttagtctcatagaaaatatagaaccttacattgggtataagttactttgccttttagcggaacataacattgttaaatcggtgtggaccacaaactttgatgggttaatcgtacgtgcagctcatcagaatagattaactcctatcgaaataaatttagataatgtagatagaatttatcgaaatcaaagctctaaagaactcttgactattgccttgcacggggattataagttttctacattaaagaatactgacgaagaactagacacccaaaatgaaacctttaaagatcacttatctaattatcatatagataagaacatgatagtaattggatatagtggtagagataagtctcttatggatgctttaaaagaaactttcacaaaaaaaggatcaggtcgtctatactggtgtgggtatggagaaaccatcaattctgaagtctcagaattattgttgactattagagcgtcaggaagagaagcttattatgtggctactgatggttttgataagacgatgattcatctttcaaaatctgcttttgaagataatccaattatttcattacaaatagatgaaacattaaaagatatatctgaaaatgaactccataatacagatttcactttaaatgtaactaaaacagacaagtatataaaaagtaatcttcatcctattatttttcccaaagaggtttttcaatttgaaatcgattatggaaatgaaaaaccttggagttttttgcgaatgcttacaaaagagacaaatacttgtgctattccttttaaaaagaaagtctttgcattaggaacattgagtgaaataaatgctacatttaaaaactatcttagaagtgatattaagcgtgaagctatttctaaaaaagatatagaaaatgttggagcatttagggcattaatgctacaggctgtcttaaagtatttcacacatgacccaaatattgagtcagataataaagataaactttggatgaagtcgtcagaacgcaatattggaaatatatcaattcacaaagcattatccctatcgttattttttagcaacaataacgattatgcttatttatcattctctcctactgtctatttaacttctccagaggagataggtataaaaaagaaacaggaaatcagtaagaaattattagaaaagctctataataataaatatgatgaatatctatctttatggaatactttattatttgaaaataagcgattgaagtttgaatatccattatgttcaggaaccggatttgagtttcaaatttcctgtaattctgcttatggtgaaatcaatgtcttggattctaattttagaacatatagcctcccatctttcgataagagaaaagctccatttaagggagtacagttcttggaacctcaattagtattccgaagcaaagtaaatgataacgaatctcgagactatcatccaatgcgaggattaactagtaatagaccttatgatgtaattctaaatggaagaatttactctaacgaaattaatttatctgtgatttgtggccaaaagtattctaatgctttttactcatttctatcacaattacaaacaaaacatttcacaggaaatatcaatccagactacttgattgattatccagggtttacttctatttttaatatacctatcaacgttccttactttgaagataaagacaattggtataatttagatttccaaaatgacaataatctagaggctcataaaaatgctcttcaactagctagacttatcacttcaaaaattgaccaaatagcaaatactcatacacagagtacaattgttatattcatccctgaagagtggagaacttttgagagttatatatacaaaggtgaaagttttgatctacatgactatataaaggcgtttgctgcctcaaggggtatttcaacacaattaataagagaagatacattaaatgacagtttaaaatgtcagatttattggtggctttctctctcattctatgttaaatcattcagaaccccatggatattaaataatcaagaaaaaaacacagcttatgcaggcataggatacagtatttctaaaattctagataaaccggaaattgttattggatgtagccatatatatgattctaacggacaaggattaaaatataaattatccaaaattgatgactattatttagataaacattcaaatccatatttatcatataatgatgcttttcaatttggagtttcaataagagaattattttaccaatctctggacaagcttccagagagagttgtaatacataaacgaacaaaatttacagaagatgaaataaatggaattaaaaccagcttaaataaggctggtattcatagaatcgatttgattgagattaactatgagtcagatgctcgttttttggcaatgcgtgttgataatcaagcacaaatgctgcaagcagatgggtttcctatttcgagaggtacctgtattttgacaaataagaactctgcactgctttggacacatggaatagttccttctgttagacagaataattacaaattctatttaggcggaaggagtattccagctcctcttaaaattaccaaacattatggtgatagtaatattaacactattgcttctgaaatcctagggttaactaaaatgaattggaactcatttgacttgtattctaagttaccctctactattgattcctccaatcagatcgctagaataggaaaattgttatctcgatttgaaggaaaaacttatgattataggctttttatctaaaaaatatgatattagaattactccagaatgtataataaacaaataataagaaataaccatggacagaagtttaccagtattgttaaagcgtttctcgccagcaaatgatttacaaacattatcggtgcaatttacagaaatagcaagagcagctttgtacggaggttattttgtcgttaataaagatgaatatcatatttatctgttagatatagaattctatttccacagcgaagaaacagatgggatacatgagcctaaaatgtaccataaaggtaatctgcctttctttcccaaaggtacactttggccccatttatcgggagtggatgtaacttttgaggatgatgaataccaaaagtatcgggcttccttcttgatccgtggctataaatatattggaaaggatggagaggaatacatcaatggtacagatgattttcacccacaacatttatgggaggacctgtttggtaacgcttcttttctacgccccagtggtttaaccataaaatggcaatcgaatatatattctgaggatgaaccactcattcagtctgcacgtataagaatgccacagtatgaaagtgaaaacgagcctcacccatggaggttttctaaaaaataatatatagttaagaaagtctgaatccgcaaaacaattcaaaataaaattatggcactttacaaatataatacttcaggcgtcttttctgaaataaaggaaaagccttttaaattggaaagagatattcaacgcatgtttgaaaccaatatgtccgaaatcatgggacttgaaatgataaagtccgaatttacgatcaaagaccgccgtattgatacgcttgcctttgatcctcaatcgaaggcttttgttatcattgaatataagagggaaagaaactccagtgtcatagatcaagggtttacttacctaagcctaatgctgcaaaaccaggctgattttattctggaatataatgaaacacaagctaggaacttgaaacggaatgatgtggactggtcgcagacaaaagtcgtttttgtttcacaaggattcacgcctaaccaacgagaggctgtcaatttcaaagatttatccattgagttatgggaagtgaagcgctatgagaatgatagtgtttccatcactcctattcgcaaaagtcacgcatcggcaagcattaaaacagtgatgcagaatagtccggaatttaaagaagtgacagagaaaattaaagagtattcggaggaaaatttattaaaaggaaaatctgatgatgtagtagaattatacgagagttataagaatgcaattcttaatttgaatacagaaattgaagttaaaccacaaaaatggtatgtttcattcaaaaaggccaacagccatatttgtgcacttgaaatccagaaaaatggaataaagcttactataaatgtagccaaaggacatttagaagatagcaagcaattaacaagggatatttcaactgtcggacattttggcaatggagattatgaactcaaaatctcggatactaaatatttagaatatatcatgagccttgtgaagcaagcgattaaataaatatggctaattattgtaacatagaccaatacttatataattatctgaaaggtttttgggtagataaaaaactccatggagtattcccttcaagaacctggcaatataacagatatatccaaatctcaactccagtaaatgactcttctattcactatgaatatcgtatagataatgaatggaatgggttagttgaacttcatatagaaggacgctatactcaaaccgactatatgcgttttttacgttatttacagaagcagacagagagcaatcctgatttatcatggcatcaatggggaaaatgtaaaggacgatgcagtattgaaattacaatcaataattgggaggacataaagaatgcattccagaagctgataatgtttttcgatccgttgctgacggattgtattgataaattcaatcttcacagaaagaatgagatttccagcccatacacacgggaattagagtttaaagaacttaccaattctcaagaaaaggtcgttttggaaaccaaaaatttgcaagatttattttcttccaatttggttattcccgattatcagcgaacctattgctgggaagataaaaatgttacagacctttgggacaatttgcttgaaatgccccacaacagtgactatcatttaggatctatcatcttacaaagaagaactgtgaatgattgcactctttacaacataattgatggacaacaacgccttgtcactttaacgcttattatgcgcgagttaggatatacggggcagatgcctttgcttaaacaaaaattcatatcaaaagacgcacgtctccatgtggccaataacaaagcactgattagaactctcaatcagagaaatacagacacaactatgttggaacgtctgtcccatcacctgattttctctgtactaattcttaatgatagcaatctcgatctggcatatacattcttctcaaatcagaattcaaagggtgtatcgctttcagactatgatttgttaaaagcgcaccatctacgctatctaaacattgaggatcaggcagaacatcttgctatgcggtggaatgatctctcattagaatgtgacaacaatggagattcatatcttacccatactttgggagtacatctcttcagattaagaaaatggatgcggaagcataatgtggaggaatttcagccacgcaaggtaaaggaagagttttcggctgcccgtattatgtccagtattcctgcttttggagaaaaattctatttctatgagaaaatccaaggtggttcgcatttctttgcatacacttctatttttgtagataaatacaaggagtttatccgtaccaggcaaatacagctactaaggaatcaccttcaatgggagtcccattggaaatatgccgatattatagaaagcctcatgttcggttattttataaaattcgggcatcaatatttatctgaagcgttgttctgtattgccggaatcatggcgcagcatagatatagtgccacgcgtgccatcttttataagattcgtgaattcgcaaaagattcagaaattataatgatgatagatcaggcatcttcgcccacattcttttttgccgaagccattccttatatcaggattagtggattggagcaagaaggtgacatcaaagagcgattctatagatgtttaagacgtatcttctgtgagctgaatgatttttcggataaaacaataatcgaaaagagaaacaatgaatatggagaataaatatacgccggaacttattgcaacaagccagtttaagttttctattccgctttaccagcgtttatttgcatggaaaaggaaagaggttaccaaacttctttttgatctaaaagagcattttgcaaagatgcctgccgatgagccatattatctcggtatgcttacttgtattgatatgaaaaatcattatgacttaattgacggtcagcaacgatttactgtcataactctttttgccatcatttttaaggaatatgatgataaatggtccggtttcttgatggatggtaatcgccttaatttcatagcgagaagcgatgataaggcatatataaagagcaagatcaaaggctatccgactaaagcgtatgtcaataagaatatggaagagggactcgccgctataactggtttcttagaatccaattttaatactcaggaggaacggattgagtttgtgcaacaagttttcacacgattgacatttttcttttcttacttgccatcaagctatcttgcagataccacttcgctgaataaatattttgaagcaatgaatgcacaaggaaaaggactagaacagcatgagattcttaaagtgcaactgatgcggggagaaaaagaacaggattacttgacgcatatttggaatctgacctccatgatggatcatcctatcattgcaaaggaagaagaccaggacgaggcttgttatcgtcaattttatgaagaagctataagtctctgccgtcagaaacggtttcatgaagctttagaaaagtgcagatatacgtctctcgatgacgaggaggagtattctatagatgtgatccaacctgaaaaaatagaatttaagcagaatagctatgaagatggtgaaaacagtattatatcatttccggagtttcttcttttggtacttgatgtatgtactggcggtgagcaaccagccagtcattatcagccggataaactgatagagaagtttgatgctctgaaaacatacttcactgcaggggaattttacgagaaaatgctttattaccggctactgcttgattattatacgattagaagagatatcaaggatgggcaaggtaattacagtttaatcctgaaaggtccaaaggatgatagtgataaattaaagcaataccaatcgatgctttacgtttcaacggaggctttctacaattggctcaaaccttatttgagaaaattagagcaagatgaactccactcctgtgcagagatgctcgcattccttaaaaaaggagataatgaacgtcacagcatattacctgccagaaaagatctttcatataaagcatccggtaacattaggtactggttttggcgtttagactattacctttgggaacaacgcagcactttcttcaatgaagaagaacagaagattgtagagcactatgtgtttcggagaaatcgttctattgaacatctgcatcctcaagacgaatcgcacaatgaagaatgggaggaagaagctgtacattcatttggcaatcttgccatgatttctcaaagtttcaattcacaacaaagtaatgaccatatacaaataaagtttgcccgaatccatgagcaaatcagcaacaaatcactgcaaagcattaagatgtttttaatgtgtaaactcgctgactttaactatcaaaattggacaatgaaattggctaaagaacacgaaaatgaaatgattgaatttttagaacggtctttctatatatcagattgaatcgtatattgttatataacacattattttagtctaagttcaaatacttgataggtttcctttaattagcaaagttcacttaatcgcacacaattgtattagaaattaacagagctatatgttcttctctatctaatatttacaatgaatatagtacatattttagtttatatcatttaaactgaaaatatgtactatatattcttttaccctataatacttttaatgtaatccgtaggacatacatgatagaagtctttgaacttctttccaaaatatttagcatcacaatatcccagcattcctgcaatttccgaaacagtgtactgttgggaggctagcagtttaagtgccctgtccattttgaacgaatagatataattttccggaggattcccggttatctctcgtatcctgctataaaaagcagtacggctcattcctatatcgatacttaatttatctattgtatatttatcagtagagatgttcttttccaggattttattgactttatccataaatatctgatccgtattttctgtttccatttcttctttggtggggaccattggaaaaacagcatctgacaaaaacaatttgacccgttcacgcaagaccatgcggttttctacaagcatacgtatgtttgcccttagcctgcaaatgctttctgttcgtaattccagacgatccgccccacttcctaaatgagacaaataactttcgttatcaaaggcccttatcaaaagaacaaccggtatataccctatcattttatctgttttgatccggaaacagagtgcatctccatttgttccgtttacattatcgtcaataatgatagcatcaggattttggcggactactgtatccttcagcaaatcaggatctttcaaaactgaaatctgaaaataccgcgataaagctttccttaaataattcctgaatgccccgtccgccattaccaataagatatgggatgtatcttttgttttagcattcggggtatcatctttatcactttcagaagattttttagccttattcttcgtgtttgttgaagaatgtttgatagccgaacattcctgattccggcaatgacaatctgttggaatgacaatttggaaagcaaatgatttgccatgtctatatccgtttatttttccaccatgcaggcgaatgatttttcttacagtccacaaatcactatacccatatatgggaaatatgaccggaataaaaggaaacattttccctactcttttgtctgctatctcacaattagtaatctgcaactgccaggaatctattgtatgtgttatattgattgatatgcaacagcctaaatcggaagccaaaattagtttgcttataagatgctgaagcgctgccgtcataatgttttcattgattctgcaactgacgcaatccgaacattcgctgacagtcagttgtatacggcgcgaatcagcataaggtcgacattgattgacaatagaagtaatataagaagagagttccaaatttgccgttgatgtcttaggaagtatttttttgtttaccttattgagggttacaatattctgattgcaatatatgatgtattcggtatatctcaatgcctcttctacttgttgggaaagcgattcgggaagattaccggttttaagttcttccaattgatttcgtaacaatatcaacggggtatacgtagtatggagcatgttcatagctatcttaagtttttcatgtgacaacaactgaacattatactctaccgcaagatacgcaaacaaaacaataaatagcccaatgccgaaactctctacaggaactgcataaccaagcaatgacaaatcaggcaaaattacgccaatagcttgtttactgtttactaaattggctccactatctatagaaagtaaagcgcgaaagtttaataataaactcaggtaacaatcattcatacttatataggatttgattaatacttacattttcagcaaaacacgtttgatgaccttttaacgtgtctaaatccggaacaagtataaacttttcaacgtccacatatggggtggattctaacaaaaacaatgggtgttttctatcaaaagtggtaacaatatcgtttgttaccgaaatatcaaagaatagattctaaaatcatcattttatttggcgaaacgtagtgattgtcaaatattatgccatacaataacacaaccatacgatcatatagttccacttaatcattaaaataatgaaataagtagaattataaagccgcgtatataatttgaaaataatagactttagataagtattgtcagatcatgatttacaggaatacctcatcataagacggaataatcttcgcatcgtaaacgtgagtgaccgcaaatacatcgtctttctttattaacagccagtctttatcctgatcatccatattggtatgtataaggacaaatagccctttgagtttatgcccgtgtaacttgaattcaagtattccatttttaatggcagcggaaatgttacgattattaccaacgtaagcataggttccactatcccatatttccaccgtacctgctccatagttaccttccggtataactccttcaaagtgcgcataactcaaggggtggtcttctacttctatggccaacctcttatcttttggattcatggaaggtcctttaggcaccacccaactttttaatactccatctacttccaaacgaaaatcgaaatgaaaatgactggcatcatgcttttgaacaacaaaaacaggcattcgattgggagtttctaccgtctccgccatcggttccggtgttttaccgaattgcctttttgcccggtactctttgaggttgatcatagaggcttcagccgcctgcttttctaccattttgatattttttccttcatcgggagaattctttgccataatctgtattttttaggtgaataaaaaaacgaatgattcaatgtacaacaatcagtatatctgtttgtttgtcgaaattcatctattttaatggctttataactgcatttaagtttgctaacttatttttattcttctccctttcttactgcctgcatagtgggtacaaaaatccctttcaatcgtccttttataaaagtataaaagcaattggaaggaaatgaataaaaagagattaatcggatatctgttcgtcacgatgtctgttggttgtattcaggcgcaggaacagaagtcttctgtacccgaatacaagctatggtacgactgtcccgcacaggtatggaccgaagcattaccccttgggaatggccgtttgggggccatggtatatggaacaccaggcacagaacaaatacaactaaacgaagaaagcatttgggcgggacgtcccaataataacgccaatccggatgcactggaatatattccgaaagtgcgtgagctggtctttgccggaaaatatcttgaagctcagacactggccacagaaaaggtaatggcaaagactaattcaggaatgccatatcaaagttttggtgacctgcgaatcgcttttcccggtcatacacgttattccaattattacagggaattaagtctggattccgcacgtgcaatcgtacgttatgaagtagacggagtgcagtatcaacgcgaaacgatcacctcattcaccgatcaggtagtaatggtacgactgaccgccaatcgtcccggacaaattactttcaatgcacaactcacttcgccgcaccaagatgttatgatcgcttctgaagagggaaactgtgtgacactctcgggagtctcttccttgcatgaggggctcaaagggaaagtagaatttcaaggcagattgactgctaaaaataaaggtgggaaaatagcttgtgccgatggtgtcctttccgttgaaggagctgatgaagctacggtctatgtatctattgccaccaacttcaacaattatcaagacatcaccggtaatcagacagagcgggctaagaattatttggcgaaagcaatggttcatccgttcattgaatcgaagaagaatcatgttgatttttaccgacaatatctgacacgcgtttctcttgatttgggacgagaccaatatgcgaatgtaaccaccgataagcgtgtggagaatttcaaaaacaccaatgacacacatctggttgccacctattttcaattcggacgttatttgttgatctgttcttcccaaccgggaggacaacccgccaatttacaaggaatttggaatgacaaattattcccttcctgggatagcaaatatacttgtaacatcaatttggaaatgaattactggccttcggaagtaacgaatctaagtgaactgaatgaaccgttattccgtctgataaaagaagtgagtaacacaggaaaagagacggctaagattatgtatggagccaatggatgggtgttgcatcataacacggatatatggcgtattacaggagcagttgacaaagctccttcgggtatgtggcccagtggtggcgcatggctttgccgacatctttgggagcgttatctatacaccggagatgtggaattcctgcgttctgtctatccgatactgaaagagtccggacgtttctttgatgaaattatggtgaaagaacccgtacacaactggctggtagtctgccccagtaattcaccggagaatgtacattcgggaagtaacgggaaagctactacagctgccggatgcaccatggacaaccaattgattttcgatctttggacagcaattatatctgcttctcaaatactggatatagaccgggaatttgcctctcatctgacacaacgtctcaaagaaatggctcccatgcaggtgggacattgggggcaattacaagagtggatgttcgactgggatgatccgaaggacgtgcaccgccacatttctcatttgtacggactcttccccagcaatcagatttccccttaccgtactcctgaattatttgatgcagcacgtacttctctgattcatcgtggcgacccgtcgaccgggtggagcatgggatggaaagtttgcctttgggcacgcctgcttgatggcgaccacgcctacaagttgataactgaccagctgactctcgtacgcaatgaaaagaaaaaaggaggcacctaccctaacctgttcgatgcgcatccgccatttcaaattgatggaaactttggttgtgccgcaggcattgcagagatgttgatgcaaagctacgacggttttatatatttgcttcccgcactgcctaccatttggaaagcaggttctatcaaaggaatcattgcccgtggaggtttcgaacttgatttgagttggaaaaacgggaaagttagccggctggttgtcaaatctcataagggaggaaattgtcgtttacgttcgctcaacccattaaccgggaatggcttgaagcgtgccaaaggtgaaaatccgaaccctctttatgcagtccccaccattccggagccattgattaacgaaaaggccaacttgaacaaagtggaaattgcagagacatacctctatgacctacctaccaaagcaggaaaagaatatgtattgattggaaaataataactcgaccgatatgaacaaaaacttattgaaactgattgtcgcctgtggaactgcttgtttcctggcttgcgcagcacctcaaaaaacagaaacggaaaaatggagtgaacgcatggcacgctccgaaatgaaacgtttccccgaaccctggatgattgaaaaagctaaaaaaccacgctggggatatacccacggactagtagtgaaatccatgttggaagaatggaaacatactggggacagcgtatattatgagtatgccaagatatatgcagatagtctgatcgatgctgacggacatatcaaaaccatgaaatatctttcattcaatattgataatgtcaacggtggaaagattcttttcgatctttacgcacagactggagacgaacgctacaaaatagccatggatactttgcgcaagcaaatggcagagcaaccccgtaccagtgagggaggattctggcataaattgagatatcctcatcaaatgtggctggacggaatttttatggcttctccttatctggttcaatatggggctacttttaatgaacccgctttatttgacgaagcaacaaaacagattcttttgataaatagcaagacttatgatcctgcaacagggcttttttatcacggatgggatgaaagtcgcgaacagaaatggtcaaatcctgaaacaggttgttctcctaatttttggagtcgcagtatcggatggtatggagctgctattgtagatgtactggacttcctgccacaggaaactgccggacgtgacagcattatacaaattctgcagggattggcaaaagcgattgtgaaataccaagatccttcatccggaacctggtatcaggtaaccgatcagggagcacgtgaaggtaattatttggaatcatctgccactgccctgtttatctatacgcttgccaaagctatcaataaaggatatattggcaacgagtatatcgaaccgacacaaaaagcctttgacggaatggtaaagacatttacccgtttggaagaagatggcagctatacaattaccaattgctgtgctgttgcaggattgggcggagattcaaaaagatatcgtgacggctcatttgaatattatatcagtgaaccgattatagaaaatgatccgaaatcggtaggttcattcatcttggctgctattgagtatgagaaaatgactaaaaaataaactaaaaacgataaaatacaatgagaaaattcaagattattccccttttgttgctgctattgacaatggcaacttcggctgcagcacagaagaaaacacaaaagacgtatatcccctgggacaacggcaaactcgtagtttccgaagagggacgttacctgaaacacgaaaacggtgctcctttcttttggttaggagaaaccggttggctattgcccgaacgcttgaaccgggatgaagccgaatattacctggaacaatgcaaacgtcgcggatacaacgtgattcaggttcaaacgttgaacaatgttccgtctatgaatatctacggacaatattcgatgattgacggatacaacttcaaaaacatcaatcaaaaaggcgtatacggttattgggatcacatggattacatcatccgtacagcagcaaagaagggacaatatatcggcatggtctgcatttggggaagcccggtgaaccggggcgagatgactgtagaacaggcaaaagcatacggcaagtttttggcagagcgttataaggacgaaccgaatattatctggtttattggtggagatatccgtggcgacgtgaaaactgctgaatgggaagctttggcaacctctatcaaagctatcgacaaaaatcacctgatgacattccatccacgtggaagaacaacttccgcaacttggttcaataatgctccctggttggatttcaacatgtttcaaagcggacatcgtcgctatggacaacgtttcggagatggtgactaccctatcgaagaaaatacggaagaagataactggcgttttgtagaacgcagcctggccatgaaacccatgaagcctgtgattgacggtgaaccgatctatgaagaaatacctcatggtctgcacgatgaaaacgaactgttgtggaaggattatgacgtacgtcgttatgcttattggtctgtatttgcaggttctttcggacatacttacggtcataattccatcatgcaatttatcaaaccgggtgtaggtggtgcttatggtgcaaagaagccttggtatgatgcgttgaatgatccgggctacaatcagatgaagtatctgaaaaacctgatgttgactttcccgttctttgaacgcatacccgatcagtctatcatcacaggacagaatggagaacgttatgaccgcgctatcgctacacgtggaaatgattatctgatggtatacaactataccggacgtccgatggaagttgatttcagcaagattagcggcgcgaaaaagaatgcttggtggtacaccacgaaagatggtaaactggaatacatcggagaatttgataacggagtgcacaaattccagcacgacagtggttattgcagtggaaacgaccatatcctgattgtagtggacagtagtaagaactatatagggaaagactggacagagttaccggacgcacaacaaaaatggaataaataatcttatataaacgaatgatgaaaacatacttatgaataaaagaatagtatcatttttctttcttctgctctttgcaggttcactatacgcagccataggtataattgacctgcgaacggagcagttgaaaaatccggcaggtatcgatgtgcgccaaccccgattgagctggcgcatcgaatcggatgaacagaatgtgatacaaactgcgtatcacattcttatcgcatcttccccggagctattggaacaaggaaaaggagatatttgggattcaggaaagattgaatctgacgcttcccaatggatcacttatcagggaaaaacattaaaatgtaatgcctcctactattggaaagtgaaaatagacaccaacaaaggtgcaacaaattggagtgctccggctttctggaccaccggactatttaatgaagcggactggcaagggcaatggatcggcttggacagggccgctcccggagacagcgaaacacaatggagccgtttggcagcccgttatctccgtaaagagtttgcagtaaagaaaagtgtgaaacgtgccacagtacatatcgccggaatgggattgtacgagttgtttatcaacggacaacgcatcggcaatcaagtactggcacctgctcctaccgactaccggaaaacaattctgtacaacacatacgatgttacttcactgcttcaaacagaaaatgctattggagtaactcttggaaatggtcgcttctatacgatgcgtcagaactataaaccgtataagataccgactttcggttatcctaaactccggttgaatctgattgtggaatatgcagacggcagcaaagaaacgattgctacaaacacttcatggaaattgactactgaaggtcctatccgtagcaataatgaatatgatggcgaagaatatgatgctcgtaaagagctaggagcctggactcaaaccggatatgatgacaaaaactggatgccggcccaacgtgtcagtattccttcaggaacattgcgtgcacaaatgatgccgggcatgaaagttacagaaaccctgaagcccgtttctataaaaaagcttggtaacaaatatatcctggatatcggtcagaatatggcaggctgggtacgtttccggataaaaggacaggctggcgatagcatccgtctccgttttgcagaaagtctgcaagacaatggcgaactttatactagaaacttcagggatgcccgttctacagatgtatatgttgtcagcggacgcgaaacaaaagatgctacctgggcacctcgttttatttatcatgggttccgttatgtagaagtcagcgattatccgaatgcgaaggcagaagatttcgttgccgaagtagtagaagatgaaatggagcatatcggtactttcaactgttctgacgaaactctgaataaaattatccgtaatgcattttggggaatccggagcaactataaagggatgccggttgactgtccgcaacggaatgaacgccaaccatggttgggcgaccgtaccatgggctgttggggagaaagcatgcttttcgataattacgccatgtataccaaatggacgcgtgacatccgcgaagcacaacgggaagacggctgtattcctgatgtagccccggcatactggaactactactcggacaatgtgacctggcctgccgctttaccaatggcctgcgacatgcttttcacaaactttggagataaacgtccgatcgaagagaattatccggctatcaagaagtgggtatctcatatccgggaatactacatgacagaagattttatcatcaccaaagataaatatggtgactggtgcgttccgcccgaatcactggagttaattcatagcaaggacccttcccgcaagactgacggagctctgatcgcaaccgcttattatctgaaagtattacaactgatgcaccgctttgcaagcctgcaagggctgaaagctgacgcagaagaatgggaagatttggaacatcgcatgaaagacgcattcaatgcccgttttctacacataaaagaaggtacttctcccgtaccgggacataccttatatccggacagtattttctacggtaacaacacagttactgccaatatcttgccacttgcttttggtctggtgccaaagaactacatcaatgaagtagctaaaaatgccgtaacttccattattacaaccaacaagggacatataagtaccggagtgatcggtgtacaatggttattgcgtgaattgagccgtcgcgggcatgccaatgttgcttatctactggctaccaataaaacatatccttcctggggatatatggttgaaaaaggtgctaccactatttgggagttatggaacggtgatacggcaaatcctgaaatgaatagcggtaatcacgtgatgcttttaggtgatttattaccgtggtgcttcaataacttggcaggtattcgtgcggaccgctggaaatccggttacaagcatatcgtcttccagccggcttttgaaattcaggaattgagtaacgtggatgcatcgtacatgagtatctacggaaaaataaccagccgatggacaaagactcccacacatttggaatgggatattgaacttcccgccaatacgacgggggaagtacatcttccggatggacggaaagaaaaaatcggatcaggaaaatatcatttcagtgtagacattcccacccggaatgcggctattctaagtgatgagttcctatacgaaaacgcttctttccccgaatgtcatggagctacgatagtagagctgaaaaatggtgatctcgtagcctctttcttcggaggaaccaaagagcgcaatccggattgttgcatctgggtatgtcgtaaacctaaaggctctaaagaatggaccgcccccaaacttgctgccgacggtgtgttttcactcaaagacccacaagcagtattggccggaatcgattcaacctgtaccccggtgaaagatgcaaaaggaacacttattgcccgcagaaaagcttgctggaacccggttcttttccagattcccggaggtgacctgattctgttttataaaataggtttgaaagtgagcgactggacaggatggcttgtccgttcacgcgacggaggaaaaacctggagcaaacgcgaagcgcttccgaaaggttttcttggacctattaagaataaaccggaatatatcaatgggcgtatcatctgcccttccagtacggaaggaagtaacggatggcgtgtccatttcgagatttccgatgataaaggcaagacctggaagatggtcggaccactggatgccgagttatctgtccccacccaaaatcgtaaaaagggaggtgtgaatgtggatgaccaagaaggcggagaagcgatcaaaggagaaggagccaaacctgtttatgcaatacaacccagtattctgaagcataaggacggaagattacagatactctgtcgtacacgtaacgcacaggtagcaactgcgtggagcagtgataatggtgacacatggagtaaagtaacgctgctgaatgtcccgaataataattccggtacggatgccgtgacaatgaaagacggtagacatatccttatctacaataatttctctacattgcccggaactccgaaaggtccgcgtactccgctctgtgtggccgtttcagaagatggtatcaattggcaacctgttcttacattagaagatagtccaatcagccaatactcttaccctagcattattcaggggaaagacgggaagttgcatgccatttacacttggcgccgtcaacgaattaaatatgcagagatagatccgacgaagttttaaattttgaacgatcatctgaatgaaatcgaccgctcctttgcctgcaaaagagtggtcgattcttgtatttatccattttatactttacatttgccaataaataaaaaataacgatggcagataattacatagagagacaacaggaacaatacgaagccagaaaagctgcttggaaacaagcacaaaaatatggtaagaagaaaccaacaacagtacgtccagctgaatcgaagtctcacacttcaacggtttcaaaaccggaagactcaaaaagaagagtatttataacaggcggagcggaaggaataggcaaagcaatagtagaagctttttgcctagctggaaatcaagttgccttttgtgatataaacgaaacatcgggacaggagactgcgaaggcaaccggggctacattccataaggtcgacgtaagtgataaaaacgcacttgaaagttgtatgcaaaccattcttgccgaatggaacgatattgatattattgtcaacaacgtcggtatcagcaaattttcttctatcacagagacaagtgtagaagatttcgacaaaattctttctattaacctgcgtcctgtattcatcacttcccggctgcttgccatccatcgtaaaaagcagccctctcccaacccatacggccgaattgtaaatatctgctctacacgttatctgatgagtgaaccgggaagtgaaggttatgcagcatcgaaaggtggtatctattctttgactcatgcattggctttgtctttatccgaatggaatatcacagtaaattccattgctccgggatggatacagactcatgattatgctcaactccaaccggaagaccattcacagcatccttcacgccgggtaggtaaaccggaagatattgcccgcatgtgtctgtttctctgcgaggaaaacaatgatttcatcaatggagaaaacatcactattgacgggggaatgacgaaaaagatgatttatattgaatagtttgaagtaaagtcatcaccaagagaatctttcaacacgtttcgagtaacttccactcctgtcttcacaatcaaagcttcgtgaaagtgatagcagtgttttttgagagctaaagcatagttttagatatgataaagctatgctttgtcagttgcaaagcatagctctattatattcttctattatcccggagattttccggttatgtaggaggttaagggtttaccctcatttatttctttccttgagccttcttttctgcgtttcgcttattcacgtaatctttgaacatctgccgccagttgcgaccatgctcattgaaatactgttcgcatttggttttataaatttcgaagatagcagaaatctgcttcatattcttgtagtcaatagcctgttcacgagccaatttcaactgttccagaacgaaagccgtttcctcttccgtcatattgggtacaatggcctgataacctttcaaggtaaaagcaactttacctaccgtgtatttatccaggatttgttcaatctgttcttccgtcaatactctgtgtaaatctttcattagcctttcatgcacttctttcggcatagcagaatctgcaatcatttcacggtcgagcttagaaagcggtttgcctgtcagaggattgataccctcggggattgttgtataagggtgctcattgtgccagtcacgcactttacgaagatgattataaatggcagttactgcaaaacctgcttttttatcatcgttcaactctaaagaagctacccagtcgatggctttcttttcgagagaagcatctgattttaaattagcaaaagccttcttgtcaaaataagcagctaccttgtcaaaagaacggatggcgccttcaggaagcaaagctcctttttcgccaaaactatacatagcggattccggttcaatggtgaccttgctttcatccaacatctttttatccaatttgaatacttctgcgaagaagtcataaacagcattccgcttattcgggccaaagtcatgtttctctttgggaagatgtacattcgttactttatcttttgcctggtagaatccgtagattcgttgcagataaggaaattcaagagtaggaacactggccgtccagtcgccgccatccgatacgatcagttgtggacgaggagcaaaagtagcggctaattccgcattacaggttcctcctgcagatagttgaataggcattccgctttcgcagggacaaccaccgtcgaagtgagaagccaggctcaccaccggagctgaagcggtgaaacgatcatctaatacgctcaacaatacagtatgggtacctccacccgaaccgccattcgtaccgatacggctggtatcaatgtccttacgggaagcaagcatgtagtcaagaatcagtaagccgttcattgcctgaatagtgtgcgccgcactactacggtgtgccgcactgcccacttgcaaagccgactctccccatccgaacaaatcatagtctacacaaacagctcccatacgtgctaaagttcccatacgttgttgttggtcttcccgataacgtccgccaccaaaatgtccgttagggcagattatcaacgcatgttttcctttcgattggggcgtatagatagaaccgcaaacgtataacccgggaagtgtttcaagcgcgaaattctgcacggtatagccatcaaacttacgtatctttgaaagaataggtttggatttgacacattgagccaacaaagtatcgatacctaaacgctgacgtacctcttttttcagagaatcggcacgaagttgaaaagactgtcggtctgtatagagtgtattcagataagccagcatcttctctccgtctgcatctgtacgacgtggatactcgtatgctttcagcttatacatatttcctttctgcttaacaaatttataatcgaaaggtgccaatacattcgtcaaggattcttccacggaataaggacgaatacggaaatcggcataaggcagcacttttcccaccgtatcaatgtcatatttcaaacggactccgaaacggttctgtatatccgtcagtacttcattcaagggacgggcaaattctgtctcgtatgtttgcgtctgggcttcggccgaaagagatgcggcaagaagcatagtaaaaaggattcgtttcatttatttttaatttatgtaagttgttttttcaccacagattacacagattttcacagatttattattcttataatttagtcgaattaaaaatctgtgttaatctgtagtatctgttgtgtgcttttaattacttcaccattgacgattacgtcatccatcgtgatacgttcacaattttcgaagatacatttctgtttccctccctgaatatgaatatcacgcaaaacgatgtcagatatcggcgcttcttccaagcccactattttgatcggagtctttacgtttgtcacagtcattccgctgatatgtacgttacggaatatcggagtgcgttcactcttaggttcggcaggcattttactgtatttcaaattcaatacgacagcttcctgtttaatgttgctcattacgacgttgctgacacgaatatcttcaacgactcctccccttccacgggttgacttaatacgaattccacgatctgttccgtcaaacacgcaattggaaatagtaactttacgcacactcccactcatctcgctgccgataacaacacctccatgaccggaaagcatggtacagttggtgatagtgatattctcgcaaggtactcccaaacgacgggcctgtgcatctcttcccgacttgattgtgatgcaatcgtctcctactgatatatggcagtcgctgatatgtacattgcggcaggattccggattcactccgtccgtatttggtgagggcgcattatctatggtgatcccctttatggttacattgtcacaaaactccggattgaccgtccagaagggagaatttatgattttcactccttcaatctttactttcttacaacgaacgggctgaatgaacggaggacggaaaaagcgacgttgcaatgtatttacataatccttgttcgtttcagcataaattgctgtcgtatcgtttgctgcatcccacattggctgatatttattcacatcacgcataccattgtctttcaaatcaatcatgacacgaaagaactccatccaccatttcttcccttgtccgtccaaagttccttctcctttgatcgtaatattctcggcatctactgcataaatcaaaggctggaaacttttcatcatcactccttcatgacgaacctcgacaaaaggaagatagtcatcaaagttatcggaaaagagcaaggtagctccggcttccaactccagtgtaatattacttttcagatggatactccccgtcaggtaaattccggcaggaaagaaaagagtacctccgccaccacggttcaaacggtcaattgttgaattgattagctttgtattaagagtcttgccatttgcttttgcaccggccttcagcatatctacacgctcggcacgaagaactgtggttgcacagaagcaaagaaagacgataagagttgttcgtaaattcataatcgatattattaaagtatatttcatcgtttccttctaaaaaatcatgctaatagaatctttttttcttcccaatgtttgaaaacaatcattgagatgtttttttcaaacatgctacatgattaaaataaacatgctgcatgattttttatatgaatacattgttttttaattctacaaatatatacaaaaaggttcttttattttgcacaaaccaattgatatgttccactctgtatctctttcggttctttttcgcccgggaggtaaacgacagcggtagtattcaccggaacagacacgtttaaagtgaaagtcccattctcacaagtccagtccacattaatagtaccgtataaagtttcatacgacgctttgacgtatttcaaatctcccacaggttggggagcgatgatgaacttctgataaccttgttttgtagtggtagaaggacgaataccgaccagcgaattgaagaaccattcatcaatctgtcccatcataaagtgattccaagaagaaccttgacgggggtcccactgctcggtcaaagttgtagcgccgaatttcaactggaaaccatatccgggagcttcttcatgattgaacatcttataaataagttcatgttctccattacgcgccaatgtctgaatcagataacggtttcccacatcaccggtagtcaaacggttgccatgtgcttccacatcttttatcagattcgcgaatactttctcattcaaatctgtatccggtcggtagttaccttgttcatctgcatcctgcgtcatttggaggaacagcggaagcgcattactgcattggcttcctgtaccatattgtgccgtatctttatgaagaaaacatttattaaatgcaaccattatatcctgtgccaacgaagtataataacgaatgtcaaagtcattacctaccattttcgcagcttgtaccaaatacatgactgtcatgtaataatgcgcagtagctaccaaaggaacgggcgtattccgtgagaatcccgcacgaaaatctccgtaatcataccagtctcccaatccgaaagaaagaacacctttatctgcacgagtcttgagataatccacgtaacgacgcatattcggataatatttcttaatcaatgaatcgtctccataagtctcatagtacataaaagggaaaataaccaaagagccaccccactccggagattcggcaaaagcatccatacccggaccttcaaaaatcacgtattccggagcagttgtcggcatggccccgttggaatgttgtgcatctgccatattctgcataatctgcggagcgtatgctgtcaaatcatagttatacaacaaacccggaccattcagatgtacctgttccagccacccaagtttctcacgatgcggacaatccgtaaacacagactgcatattgctgcgaaccgctttctcgatcaatcgatgggcagcattaaatatccggttggatgattcgaaagtggaaacttttctagctgaattatagacgaaacaggattgaatattctttaatacaggcaatttctgcggattcttctgtccttttaagacagcaccctctacctgaatatatctaaaaccgtaataagagaaacgaggatgccaggtttcatcgccttcccctttcagagtgtattcgtaatagtgttgacgccctgtctgacgctgattgcaagcaccttcctctgtcaatgcttcggctacaatcaaagttactttctgaccacgtttgccacgtactgttatttccggaaagccagccaaattctgtcccatatccaacacaaaagcagaaagatcgactgttctcttagttgatacagaagctgatgcaacttggtccgcatttagtttggttaccttttgaatatcataccgttccatgattttcaccggagccgccatctgtggacgaagtattcctttaggagcttcctgtatgactaccggacgccaatgactgtcatcaaagccaatctgattccatcctttctgttcacgacgcgcatcataatcttctcctccatatatgcaattgaaggttaccggactaaaatcatatttccaattattatcggaatgaaccgtcgtacatgttccatcttcgtagttaataaccagctcaaataaaagtgtgggaggaccaaagctgatctgtaatttgcgataacgccccccctgcacattatagaatccattccccaataagattcctacgacattttcaccacgccgcaattgttccgtcacatcgtatgtgttatagtaaacagttttatcataatcactccacaatggggcaaactcactgttacccacctttttgccattcaaagaaaactcatagaatcccagaccacaaacgtatgccgttgcctccactattttcttgcccggtttacggtttgcccccccttctttcgcatctcctacctggaatgttcttctcaaacaaatacttttctttgccaaagtgtccactgcttcccaagcagctttcacttccggtttcttcagctctccaccgtggaacttacgcccttccggtaaatgagcattttgtcgggtaatagctccaatccactgccccgaagataatctttcgggtactgcccggaatttcgcttcactgctccactcggaaggtgtatctgtttcatcccaaacacgaacgcgccaactataattaaatgagttatcaggacgtatatctgccccctttgtagaaactaactggctctgcgaagaataaaccttcccactattccaaacggaacgccctgtaaaagcttcccgaatatcaatctcataggcagattgtcgtgtcccattttccggcgattccatcacccagcccaaacggggtgaaccttcgaccactaccagtccctcctgcatctcacaggtaagacgactgatggttatattcttcgcctgtacaaaacaagacaaacaaaatagcaatgaaagaagaatctttttgaatttcatttttcaagtatcttttatttgttcgataaatgagaatttatcggttaggctgaaagccttacaattatatatttattggagtgccctgaaagggcttaattatatagcgtagggtaacaccctacgaaaaaaacacaccagccacaagccctgaaagggcggaactgtatacaattatgccctttcagggcgcaaattcagattgtcgtttttacgtagggcgttgccctacgctatataattaagccctttcagggcactccgcaaaattatcatttaagtgcattttcacaaacgatttttgtcaatgtattcgcctgccctacttccttaccatctacaaaaatgcgcaatccttttccgcaatgatagcgatcaccattcttatcccaaagaatcgtcagattatgaccatgatataatacattatccaggcagaaccaatcccacttgtcggcaggaattaaggggttcacttcaatcgtattatccaaacgtggacgaagtccgatcaatcctgtaattatcaggtcgttgaaagtggaatgattataataacggctacgttcctgatctcctttcagccaataaccggtcatctcatccaaatattcaccaatatagggacgaccacgatggtactgtgattccacatacaattccatctgacggaaatatacactgtcagacaatacagtctgcggataattattcataaagttagccattgctgtcaatgtctgtgcggaagcaaacggccagatagcaccgtcccactcacacttgcctactccacgtgtacgaaattccggatgacgacgttctgcggttgtcagtccataaggagcagaaaagcctttttcatccataatttctttccaggcaatttcatacttttgggtggtatccggcaggttgaaataccagggaatatatccgattgcttcacgcacatttgcagaagagtccgtacgcatcgtttcaaaaaactgatgacgtgtattccacaattcattttctaccagatttttcaaagtatctgctctcatgccatatttcatagccatcccctcatcaccggaaagaattcctatacatgaaagtgctttagcattgccatacatataactattgattgtcggccgggcatatttcttcctccgtccgccactgattgattcttccataccatcctgtacgtcaccctgccaatacaatccgttcttcaaacggttcgtacgttcccaacgctggtattcggtttccagatctttcttcatatccagcagatagtccttatcaccatctaccatgtaacgagccaaaacagcatctgcgttccatgagctgaacttatccattttcttcatcggaccgccatcattgccacgataccatgtatgaataatctgatccaaatatttcggatcacgcaaccaacggctttcataaatgtgatgtccaatagcacaagcaatcaaattatatttatctgaataagaacgctgaacgagaaactcggtcatgccatagccaacaggagtctccttgatatgcttacgcaatgaccaccaacgataataatacatttcttcaaagttatgttgcggacactcgaacaaaggaatattttcctccatccattccgaagcctttgcattgggaattgcctgaacaatattttcgtcttccataccgttgaaatagtctgcataatgactgaagtcagcatactttaaaaaagcagaagacgcatctttatctgcagaagatgttttcacattggcaatgccatattcagccaatggatcttgcgcacctgcattcggcagatcataagtctggtcggcaggagtatctacagtcgggaatgtacgaggtatgccagttcggaatacgattcgctccacagcagccacgggcgcatagaacatacgcagccctactctcttgccatctacatatacttgaatattacgatcaacagtagaaaggactgcttctacatgataaacctttcctgcttcatatttcatcatatttgcaaaccgggagccgcctttcaatcggaaaatgccatcatcagtaagttccatacgagaacaggctattccattctcatccagaaattcaatctggagtgtgcctttattattctgaccggctttcaaatcaaatgatactttcaattctttagaagccggaattttacgttccactttggcataatcaaacggatctttatcctgcaacttcaaccattgatcctccaaagaaacaggagcccaaaccggagaataaatattccagtcagtcagttccgcaattgatttatttttagagaaatcatcatccgcatgtgctgaagcatttatttccaccgggacaggaatacgggaaatccacatatcttccttgttcacactgtaagaaacccacaaatcaccatcggcaggtaccccattgccttcctgaataccacgtggatattgaggaccgtatgatttataatttcctccataacgcatgggagtgatttcaccatgcaccagattcaatgttgtatattccaatccatctttactcaaagatatagccagcggccaacgaaattccgacggattatatacagtagcgtatgtaccatcacttaaacgctgtccccaaattttcgcgttgctattaacgaaaccttttgcacgaagcacaggctctgcccaagtatgtccgccatcctcactgatagaggtaagcgcatgtttccaaagactggcaatacgtccatccggcaatgtataacaattgaatgctttgtatcctttcttcagcgggagaataggatcttcacggtcggcttcttccacccactgcatcatatacagcggattgtcaagaatttcctggcaagccttcacaaactcacgatccttgcttttcttaaaatacggataatcagtattcttttcattaaatccatgattataataaatgaaatagatcggtccgtaagaaccgtctttctttatttcacgaaccacccggccaataccgtttccatcattgggatcatcttttttatccaaagcaactccataatttcccattgtaatcagcttgccggatttagaaacatagaatccgacacgctggtgcataatggcaatcagatctttggcctgcacacccggacgagactctttggtgtatccatcgggaacttgataaggaggaaacacaaattccggatttgtccagcgatatccatccttcgatgtcatcagaaaagtctgtgaaggcggtacgtgttcgtcagaaggatctgccaggtattgatagaaaaactgtccattccaataagccagcatcggctgatgattatacgtccatccattgccgttcgaagcatcgggatgttcacgattggcacgtaccaactgaatgttatgtactccgactaccggagacagttgtccgtcgtgacaagcagggttcgataattcttttcctgtataatgaattctatcttgtgcaaaggctgtagtagtcaaccaaccggcagccagtacaaaaagaattttagcagagttgttcatgatttattctgatttaaaattgtttccgggtttatttcttttcttccagcaatgtttttacgactgattccggagccgtaaatatggttccatgcttatgccctacagggatgcttacctcttctgttacatctgtaaagttccggaaatccttcgtacgcatagcgccatatatttttttcttatatacatcaaaatagattagataatcgtctcccactttctctacagacggtccttctacaaaggattcagtgaaaggctgggatgcgggcgaataaggaccggtcatagaatcggaaaaagcgattttcagattacgttccggacgggtgttatccttgagtaccattacatagtcattctttgcccgtttcacgataacggcatcaatggtactgaatcccggatcatacaaaagttttgctttcgaaacggttttaaaatcttttgtagtgatatagtataaacgatgattattattctcttcttctatccccttttcgaaacgcccggggacacaggaagcccatactaccataaactgatcgttctcgtcgtcatagaaaatttccggagcccatacattaatagtagtcggttcgtctgccattacaggaatcatctgttgttccgaccaatggatcagatctttggaatgtgcgtagccaaatcctaaatcacctttccaacttgtagtccagaccaaatggtaggttccatccggagtacgtaccatcgagggatcccgcatgagctggtgctgtcccagttccggctttagccaaactcccggaatactgtcccagtgaattccgtcctcactatataagtatctcaacccctcatcagccggttcatgaaacgaagtgaacatgtagtagtctttgttccccccacaagaagccagaaacagaagacttattgcggctaatgtatttcttaactttttcatttctatattctatatttgtatcttttatacagaggagacgatggaaagcgccgtttgtactcaaatatactagaagaatcaatagattcaaaatttatatacgataaaagggcgactctccgagccaccctttccaccatcaaacaaactaaccatttacaatgggaaagaatttcacttctttttatagtatcttattttttaattatatagaacctccacgggcttttatacgtttataccattcctctcgttctttcttcaggtcatatccacgtttagccagatagttgttgatacgtcctttgtattttccgaaagcagcatgtttcttattcgaattttctgcatccaacgcaaattcacgtgcctctatcaaccaagcatagatttgagctttttcttcttctttcaaagtagggatcatgtccagatgtgagtcataagtcacttttactactccataagtcatgccatccttaacggcttctatttgcttttcatcaagaaagagggataaattggcaggaaaagcgaaatgtgaacgatatagcgccgcatctttttcattttccgcagctttcaaagcttcatttttagcctcaccagtcaacccggattcttttactttcttgactttcgcatcccgtacctcataaatatcatttaattcgaagtaacgattggctatgacattgcgaacatcttcggctgttttcgcatctgtaagtccgagtttatcaacgatcttttgtgatcggccgacaatagactttacacattcaggatcacgattctctttatttaagtcgactgcctgcgcagacatccaaccggaaataaaaagcaatgatagtatcagtatctttttcataattacattaattttcctttttcagccaatgtatcgtagttgtttttcatatctctccaatctactttatgctttgtgctgataccgttgatatatttttcaatattcgtatatccgtcaccagtacagtctttattggcatcactcggatcgttcggatttaatccgttagcaatttcccattcgtccggcataccatctttgtctgtatcaacataaggagtacctttgtattcaggataaccacccatctggcgaacatcagtaataataccctgcttataagaatctttcggcaaacgacgatacttgaactgtccgtcttcccccattgacttaggagacaaacctgtcaagtcaccataagcgtctttaggaagtttcttttcataataaggaatacctgttcttacttcttcaatcacgcgttcgtcaacaatatcacgacaaggaatattcgcacctacatgtttcaatacatagtcataagcatctttagcccccatgatattgatatacggcatctcgaacggcttatagctacgcatgtattcagtatatccgtcagtgttcggttgagtttcaatctgaataccgccattccagttgtctttagttatttcaggatagccttccattatatttccgtcggcatatactcgcccatattctttatgatccagcttactacgtcctgcttccggtttcaagatacgatgtcctacattggaatccttaggagtagcaggtcccggtttgtagtagttgttaatcatattgaacattgcggtataatcaccaccatcggaagaacggtgcacccaattgaatactacattattaacgaaattgaatatgccattccagccgatagaaggattacgtccggagttactagcccaaaggttacgggcaaatgcacagttctcaccacctaacgtactaccaaacgcatgattgtatgtatctaacgcttttgccgagatagtattttgaatagttacgtttacagtaggaagtttcaagtctttgctttcatattgtccttcactcgggtcgtacatgtggcgatagaaagaaatgttttcatccaatccccacgtacaggagcagtggtcgatcattatattaccaacagggttacctccgaaagagtcatcacgatgccatactttcgtttctccacgacggaaacgcatgtgacgtaccaccacatcatgtgtatctacccaaaatgattctccagcaatacaaacaccgtctcccggagctgtttgtccggcaatagttacgtaaggagcacggacgataatcggagattccagacggatgataccagcaacattaaaaacgataatacgtgcaccaccagtttcacatgcttcacggaaagaacccggtccacgatcattcagatttgtgacagttatcactttacctccacgaccaccgaaactgtacataccaccaccttcagcacctgggaatgaagggatatcagcctgtggcaaatcgtacggacgaccagcccaaggaatatatggacgtccttctctagcttctttttgtactatcggcaacgcttttgcccatgcttcatcagagcgtttccgctcttcagtcatcatttttgtatagttttctttggcttcgccagatatttgtgggtattgcgcccatgcaacggtcggagtcaacattgttgcagcaaaaactgctaaaagtacctgtttcttcttcatttttatttggttttgtgaagttgttaattcaaaaatacaataataagacgaaagaagaaaagatttgtaatcagtgatgatgatcttttatcaaatgcgggggagagaaacgactttccagtctccaatggtccgtgtagtactatcgagaatcactttgctgaaaagtgtctttttctgccggtcatttctctatcggaagaaaaaacgacgaaggaaggaatgtgtcacacacgaaatccgaataaccggaatagcttggtgtaaaagaaaagagggaatcttaagattccctcttttcacattttctcttctattagctgccgtcagagagccggatcgggagcttcgccactgtcgctgccaccggaaggaggagttactccaccgccttcatcaggatcgggagcttcaccttcaccaggcgttatcgttccgttgcctccggaaggctttgagggagccgtaatacctttacgacgattataagcagcttttgtttcggctatgacttggttgagagcagtaagaaacgctgaagcttccgttatggagggagtcagtatattgacagcggttatgtgcatcaccaagtcatcgtagagtgaatcaagctgcgcacgcacagtctttgagtccgcaaccgattctgctgtacgagtaacggaacgggcgtctgtcagtgccgaatagtttttattggcggtttcgagtgccgttaatatggcatccaaattgagtgccgtaacggcggttttcacggcttccttgcggaaatcaagcagtagtccgctgatggctgccgtttcctccatattgcgcatgcgtgccagtccggtataagggcgcaccgtgatttccaaggtattatatgcatctcgttgcgctgccaacggtgagtttttggccgcacggacagtagccaacaaataactgacatacgaatcgcgttcggcatccagtttcagtaaatcctttgtttcggcgttggccgtggaacggttcaccaggtcttccatttgtaccaacttcggcttgatgctgttcacgatgtttgttactgtcagtttggaaatacttcctgcggtgaggagtgtcagcacacgattcatgaaattggtgtactcagtgttgttcagttgtgacagtgtgataccgtctgctttttgataacttcccataattttttctttcgggattcatacttgttctatctatctctgaaaaattcgaagtccggacaagcccgcgaaatggttgctgtaaattcgcggacgttttgcatacctgtgaaagcattttttaaaatttgcaggcgtttttcaagcttgcaaaagcgatttaaaaagttttccggcattttacaagcttgggaaagcgtttctggaagtttgcaggcattcagcaggcttggggaagcgttttgagaagtttgcgaaggcaaagataactaaaatcagctgatttaacgaacaaaaattcaccaattcctgccgtcttctcaaagaaaagagggaggaaccggtgaatttctatggttttcgatgccgaagcatcctgtgattcatctccgatgtaattatccctgcaccgaaatgcagggttcttatcgaaggaagttgagttttttattcagccagcgggtcaaaagtaccgtttgcgccaccgttgttgtaatctccccagccgatggtttgcagcaatgtactattattaccctggataccttgatggaaaccaaggatataataccttggaaggaacgcgatatacaatggagaatggctatcatcataagaatcgcctttctttgtcttacgggtcaaataatttgaataaaattctttcagcctatcctgttcgctggcaagatcctttctcaaatccattgcagccggacgggtaattccagcttttactaacggatcgtcgtcaacatttgttccaccaatgccaccgtttacagttgtacggaattcaagattctcgcgacgttgtccgttgagtggcttaaaaccaagatatgtacatgtgtttccaccccagccagtcagtttccaagtagcaggcgcaccttcaggaagttctatgccgccatcaaacaacatccagcgacgcatatcatcgaaacgttttccttcgtatgccaattcaatttgacgttcatacatgatagctgccatacatttagcttggtcaccgtccaaacctgcttccaatccataattattttcagctttataaccaacacgagcacggattttttgtaattgatcaacggcaactcccatctcacccgcattacatgctgcttctgcataattaagtaatacttccgcatatctaatctccatatacggcgcggcagaacgtgtgaatcccccggacttttcatcatagacataacgggcaatagcattcacatctctgtcatcagagcgtttacgtacataaaaaccttttacatcattaaggagaccatcagcgccataggtcacactgctattggcttcaatatcatctacataagctgcatccgtataccaggtatagttccaaagttcataatcaggaccattgtgcgggtatcggttcccttgtgtcgtaggattaccgacaaacgaccaacgaactcccgggaaagcgaatgtacgatagaagcgcggatcacgatcgacgaaaggaaattcgcgataataaggtatatctgatttagttaacgtattgtatgtttcacaagttgcaggtatcttgccgtcagacataggaaacatatctaccaacatggcggaaggtgttttgccacctcctcctctagcattgtacggccggatgccattttcccatgtattattcttacgataatcaggaactccttccgtcagcgtgttgtgtagcgttacaaatacagcttcttgactcggcacttcagtaaaaagattagcccaaccggaagcgttcacaccgggattactttcattagccaagccatatccggcagctgtcagcacgtcaatagatctttttatatcattgtaagcctgtgtccaacgagacaaatcattggagcgattaaataacggactggcatatagtacacgtactcgacccaacaaagccactgctgtaccggaagtaacacgaccgtaattatcaccagacatccattgtccggctcccgtaaaaggtgctaacaatgtttcagctctctccaaatcgtcacaaataaatttgaaacaatcctttgcggaagaacggggaacaacagaactttcaacaggttcctgtacttccgtaatgatgggcacaccaccataccatttcaccaaattataatagcaccatgcacgaaagaagtaaacctgccctaacaactcattcttttcttcctgcgaaagcgtgcttccttcaatgcctgcaatgacatcattaatattacgaatacgtccataagcggaagttataggatcacctttcgttccttcaaagtaatcaggtacaggattatttccggtttgataagtcaacggcttgagtggatcgacaaaagcactgaatccactatattcttcagtcgacttagattggtcgtctgctaaaccggtactgttatacattgaactgggagtagccttaggatctggcagacatactctataaacatctgctacacgtcccagtgcaccactccaataattataagcatcggcagtagtgctgtcaaagttctgcttgtcttgcatgaactggtcgctacaagaagtaaacgcagtcatcgcccaaaaagctacgctgatacggaatatattttttcttttcattttactgttcttttagaatgttaaattaacaccaatcgtgaatttacgcagggtaggataattcccataagtagtcatcggatcaataaaattatccggataaggattatagaaacttaatagattctgtcctgtaatgttaaaacggcaactttcgatacctatcatttttgtatattttgacggtatacggtaagctaatgtaacgcgattcagtttgacacgtgttccgcttactctccagaaagaagaagttactgcattcacgctgccccatctcaagttcggatattttccattgcgattggctttcaccactacattacctgctgcatctactacgtcgttatacacaaacatattgtctgtagtccagaacgaaggcatatttgcatattccaaatcattatacttattagccgatgttccttggtttcctaaagaaattgcatcatcaggcaagaaactataaccaccccagctcgcattaaactgagctgtcaaagaaagccccttccattctgcgttcaggttcattgtcatgctgtaaggattgcttcgattagataaccgtacttggtcatcttcagagctaaccacaccatccggtccggcgtatgtaccatcatcttgtctggctccacgcacgtctttataaatcaacatacccggttttacatcttctttaacgttacccatataggaagtaatattgtacttggcaaaatactcgtcaatatcctgatagctgcggaacataccgatacactgcataccccagatgccttgatccaaacgatcacccttcttatagctcttataagtaggcttctgatcccagtctcttaccaaaatctcattatcactatacccggtgttcaactgaattttatacttaaaatccttacctatcttgtctctccatgtagcagacagttcgacaccataagtattcaattctccataattcactttcgcagaattagctcccactgtagatggaacagaggcattataactaagcaacatctcacggttccattcatagtaagcgtcaatattgaatgataaacgattatcgagaacattgaaatcaagccccaaattacctttataagatttatcccaatgagcatcccgattgattgctgcattgtttttattcattgtgaggtgactaccggcattggcctctgtactagtgccaaatactggccctttatccttatctgttccgtaagtctgcaaccattgccatgctgttgtattatcacgaccggtcaaaccaaaagatgcacgcaactttaagtaatcaatccatgtaacgttcttagtaaaccattcttcttgtgaaaccacccaaccagcagatactgacgggaaaaatccccaataattttcaggagcaaacttggtggaagaatccgaacgaagcaggaactccagtaaatatttgttatcataagaataattcaaacgaccgatataagataaattacccgactcaaaacgagtgaattctgtactaggagtactattccagtctaccgaattagattgtcctgtcgtaaattcgtatgggttagtaaccataccgtacaaatattctgtttctgattcagacttttcaatggagaataaacctcctacagaatgtagtccgaaatccctattatatgctgcagtaaagttcatctgatagttatccgaacgagtcatggaacgagacaaatatccagtaatatcacttgtactggagttaaccaccggttttccactatttgccaaataaaaactagtattttcaaatgcactgttatccgctccttcaattggagtatacaaatgttctccactaccagaacgagtctccaaataataaagattataagaagtaccataatcatttgtcttattcgtattgacactcttcgaataagtaaacttcaatttcagtcctttcaaccatttattccatccgaaatcgtattccaacccggcattaatattcatgtttgatgtcatgtttcgtttatagtcgccattattctgaagtacattgaaattgtaattctgaatattacttaccgatgaattagtaggaccgtaagcagctaccgcatattcacccacatattcgggaatataataaggatgtgtcaacagcgtattgtaatctttctctgcagacgaacctccgacctgattcagaggagtatttttctttccataatcaccggagacctgtacattcgcttttatccacttgctgattttcacatctacaccagcacggtaattccaacgattgtaatccagcttacctaagttaccatcctgatcaaaataagaaattccggcaaaataactggctttttcagtagcaccgctcaggtttacactatgctgctgcgtcaatgcggattcccaatatttatccagtaaatcatagtgcaaacttttcatggcattcaactcatcctgctgaaaaatagctcttaacggatcaatacttgtctccgtcgggtcagccatacgtactgcattccataacttgccatactcatacgcattcaacatcttaggacgagatacttcatctgtaataccaaatgttccattatatgaaattttaggcgcacctaactttcccttttttgtggttaccagaataacaccatttgctgcacgagcaccgtaaactgctgcagaagcatccttcaagatagaaatactttccacaactgatggatctaagttgttaaacgcttccgcacccaaattagtataagtacttcccacttttacttccgtaggataaatgtaaccatcaataacatacaatggctgcaggttggtacctcccatttcttccaactcaccattctgacgaatagtaatcgtagcgttttgtcccggacgagtatcacctccgtttacagagataccatttgccaaaccgctcaatgtactggccaaacttccacttgaaatatcctgaatatcatcaacgggaacagtggcgatagcaccagtcaaatgcgctttcttctgcgtaccataacccacaactacaacttcatccaattgctgcgtatcttccttcaagatgatctttgtcaatttgaatggagcagaaaaacgttgtggtacatatcctatataagagatttccacttccttaccatcaggaacattcaatgtgaaatttccatctaaatccgttattgttcccactgttgttcctacaacctttatggcagctccaataataggttgctcggtctcatccagcacaactcctttgaatgttttagtattctgtgctattgtcggcaaagccatcacaaaagctagaagcaggctgatactgattctatatatattcttatgtttcatctttatcgtattctagatttattatctttttaatttaaccaacgcgggtcgccactaccatgagcaaatacttcgggagcactcggagtaaaatcaccgtttgcagcatcagcgaatcccggatccacgccataagcagaattgctcttatcaccatccgcacgatttgaagtctcatccagtggcaatgcgccattgtaccaataacagttattttcaaaagttgcagctacctttgtaccctgcattcttatacgacgattgaaatttcccgaaaatgagtcaataaacaaattgttctttgaaattacctcattatgtgtctgtgaccaaccattgccattaaaactctgtccggaataggagagattatagaatgtattgcttataaatgtcatcgatcctcttgaccaaccatcataactggttgtttgtccacctccataacgtaaaaaacgagaaccgttttggttatgactataaatcgtagagttacttatttcgaagtctttcacaatcgaactgctagagttaaagtttatcaggtcagcagcttgatagcaatctattacacaatttctgattgcaaaattttgaataccatacttctttccgttaatgtgaactaagtattttctaacagccttgatattgcaagattgaataaccataggattagttacttttccatgatcggttctctttgtatccaatatctcttccggaacatcaccaaactttaaaaaagccccatctgtcactatatcacaatcaaagttgataaacttcaaggctaatcctccaccacaagtaataatagaagccggagcagtgaatttcacattcgcattcccgcgtgttttatttccgcgcaactgtacattatttacgccaaagttcaaatctcctgaaatataatacgtccctcctgcttccagttcgaaagcaacttctgtatcttttcccgtagtcaccggatgttcagcaaaatatgtagtcaagtctgtaccattaggaacaagcgttgcggcaacaagtgtagaccaactgatttcagtggcggaaacggaagctgtattattcaacttttcattccccaatgctgcaatctcaaccttatagttcgtatcttctacccaaggacatactacagccgtcccgtctacaatactgtccttcactacagctacaggatgatcagggtcatctacaatgtacatagaaaatttataaccacctgcccccataacaacagaccaagtaacttttacattattttcagttgtagccagtttttcaaaagccacatccgatgctttcggcgaatccaattgcgtattcgtcacgccaccggagaaggtttcttcatcaaaaccatctccagcacaagagcccataaataaaatcatcgataaacaagctatgctcccgacaactttcattttaatcttcatcttactcttcatagattaaattttaatttaaacaaaaataatatattatatcttcaaaatctaaaagttcttttaaggaaagacgtacaatcaaaaaatatgtaatcacttaaaagaataaaaaaatagattttgcacttttttctctcttaactatatcataatatcctcctatctctgttgaaacacctctttcaaatacttaatattcgtaccataattctttttcacgttccgcacgtcattcttgtcacgcgaacgttctaccaccagccatccactccatcccatcttatccagtgtctttttcaccttattcatgtccaatcgttcattataaggtaaagtcactccatctgtgtccgtacagtgaatctggcaaatcctctttttccccagaatcttcaactccttgcacaaatcccttccattctccaatgcattttgaaatttaaaatagatcttgattccgggagaattaatttctttcagtagtttcacatctccttttgcatccagttgagtttcaataccaatcaccactccttcagaagctgccatatctcctacctccttcaagcgttttacaacttctgtccgtagtgccggaatcttttcccatccggctttgattcctcccaaaggaagaaaggctactttggcattcatcactttcatggcatgaaggcaatcctgaactaaatctttataattagctcgttccagaaaagactgtccatagaaaccggacatagcaatagaagaaacttctaattgatatttttgagcagtttcacgaaataattgctggaaatggggcttgcgcaatttattatcaaacatttccctcttgccaaggccacccatatccaattctacaccgtcaccattcaattcatgtaccaattggaatgaaccgattttctgacgtttcagaatcatccagtcacatacggctattttataacgttgttccttttgctgcgatccggcaattgccaatagaggaaaacactctgcaagtatcaatatccaaaggatatgtttaaataaatttcttctcattttttattttattgcatacgatttacatagtagacgtatggaatagatttttgtaatcacctataaaacagagaataactaaaaatactacggagtataatttaataaaagtaagatagtgacggtatccaagacaaatagtgacgctatcttggtccgataccgtcactatcccgggcatataccgtcactattttcgaagaagtaataacagaagtaaatgtaaaaaaatgggctgccggactattagaagtccgacagccctgtcaacccaaaaacgatacctatgaaacactgtgtgttatttcaaatcaaactttaaatatttgccgtgaacaagttcatcatgtgtgatatgatatttattgaacttcttgccattcaatagtaccttattaatatataaaactcctggttgagtacgattggtttcaatcaccaattcgttttctttataccatttcggatctaaccggatcgttaccttattaaagaccggagtcgtcaatgtatattcgggcagtccgggacaatccggataaaaaccgatcatattgaaaatagcccaggaagacatcgttcccgtatcatcatttcctggaataccatcaggttttgttgtaaagtacttatctaataaacgctgcgtctctttctgtgtacgccattcttcacctttaaagtatgagaataaatgagcataagcaatatccggttcatttgccgggtcgtaaagtccttcgtcaaaaaccatttgtagtttatcgataaaaggtttctttccacccattaatttcgccaagccatatacatcatgtggtacatagaacgtataattccaggaattaccttcatggaaaccgggattcggttcaaagttctctccttgtctcggattaaacgggctataaaacgtcccatcggggagaatcggacggaaagttccaaattctttactataataatgtttgtatcctaaagaacgtttatagaacatctccgcatctttctttttacctaaagcagctgcaaaacgagacaatgcaaaatcggcaatataatattccaatgcatgagagacggaattgtcatactgttcacgaaggggtacatatcctttagacatataatcatcattatcaggacgcatcaagttttccgcccccggtaatgtagcagatttgtacattgcctcataagccaaatcaacatcaaagtcacgcaaacctttcatccaagtatctacaattaccggaatactcggatcaccttccattgtcaatgtttctctgccatataattcccacttaggcaaccatccatgttcacgatacatatcaagcattgtacgcaccatttccatctgacgttccgggtaaaccaaggtcagcaattgatgaacattacggtaggtatcccaaagagaaaatacggtataacgatcacctttggttgtcaggattttatcactttccattgccggatattctccgtttacatcctgcaaaatattaggatgaatcagcaaatgataaagcgctgtataaaacacagtcttttgggcatctgtaccaccttccactgttatgcgtgacaagtcatcattccatttggaacgtgcttccgcatggatcttctcaaaatcctttccagcctgttcacgatccagattcaaacgggcattttctacgcttacaaaagaaactcccatttgcacttctacctgttcaccttcttctgtatcgaaggagaaataagtaccaatgtcatctcctgctatttcttttccgtaacaagtataaagtttatactttccctgatccttatcccattcagcctcaacacccatcatcggacgttgtttcttccaataccctgttgcagaaggattcttcttaacccgcaatacaaagtaaatggggaatacagcttgaggattataacaaaatgtaccaagtagtttgactccttccacttcactatcgcttacacgacgaagcatagcgccactctcattcgttaatccctcccccaaattcagcaggatatgacttttcccttttggaaaagtaaaacgggcaataccggtacgaggagtagccgagacttctgtttttacattatatttagtcagataattagaataatagcccggtgaagcctgttcatccttatacttactaccatattctttataatccacattcagttctccggtagtaggcatcaataataaagaacctaattccggacaaccgactccactcaaattcacatgagcatatccggtaaagaaacaatttgtatattcataaggcgtagaccaccatcgggcatctttatcgtatgtgttttcggaagatcccatcacattgaaaggaaccacagacatcataccattggggcaaatcgctccgggattagtcgttccgaaatttgtagttccgataaaaggatccacataatctatcaaaagacttttatccgtatttttaaggggagggctccccccttcccccgcataggcggaaagaagggaaaaagcaagtgtgtaagttaatataatacgtttcatatctttattaaatgatactcgttcgtttcgtaaaatcgataatctcttttatatatccgaaggccatacctaccacagtatctgccgcaccataataaacagcaacacgttcaccatcttgcaaagcagcacaggggaatacgacattaggaacgtcaccctgaagttcgtaaggagcagccggaccaagcagatattcacgtgtacggtaaagaactttttccggatgatctttatccaatatggcagctcccatagcgtaacggaaaccattacaagtagtgattacaccatgatagaacagcaaccagccttcatctgtaaggaaaggaactgaacctgcaccaatcttcgtacactgccaagcgctttccgggaaaggagtcactttcattacacaacggtgttcaccccaatatttcatatccggactatagctgatgtatatatcgccaaacggagtatgtccattatcactgggacgactcaacatcgcatacttgccatcgatcttctgcgggaaaagtacaccattacgattgaaaggcaagaaagcattttcgcactggaaaaactccttaaagtcaaaagtataggcaataccaatcgtagggccatgatagccattacaccaagtcacccaataacggtcttcaatccatgtaacacgagggtcgtatttatattccgactcaatcatttccgtgttacctgctttaaactgaataggttcatgattgatatcccaatgaattccgtccttactaaaacctgcaaagatattcatctgtacagctttgttatcacaacggaatacgcctgcaaaaccatcctcaaaaggaacaacagcactattgaaaatactattagatgaaggaatatgataacgtccgataactggattttgtgagtaacgccacataacgtccgtacatccgacaggacgatcttcccaaggaatttgaattttattcataatcgttgattttatattatttattttttgagtcatcatacgtgaaaggtatgaaataagtaatcagaaaagctggaatagttgcaattaacacatagataaagaaattacgatatcctaataagtcactaagataaccactaaccattcccggaagcatcactcccagattcatgattcctgaagcaaatgcgtaatgtgacatttgatgtttgcctggagcaatctgttgcatcataaacaacgtcagtccgacaaaaccaaagccataaccaaaatattccattgttatacaagttccgatcagatatacattagtaggctgtgcaactgccaaaaaagtataggctacaaacggaagattaaaaatacagcagagagtaaatagtgtctttttcaatccgaacttagaaacataaatacctgccaacaatgagcctaaaacgaaagcagcagaaccaaagataccatttagcgtgccgatctctgttaacgacagtcctaagccgcctacatcccttgaagcacgtaaaaacagcggagctattttcatgataaagccttctgccaaacgatataaaataataaaacagatgtaataaagaatatgctttttagtaaagaagttagcaatgactgctaccaattcgtgcccaacctccgatgcagttttctttgttgttgacggaacctgtgtagaaggtaacatttttatatgataaataccgatcagtaccattattgccgcaattacgccgaaaataatcatccatgcagatgaatatgctcctttgttagcatctatcgaagcaccttctattgctccgaagtgctctgccaatgctcctgccatagcaactaatcctccattagcaaccaatttggctacattatagaaagcaccttgaactccgatatattttgcctgatcttctttgttcaattcagccatatatacaccatcacaagcaatatcgtgcgttgctccactaaaagcaatcactgccatcgtagagatacttatggcgaaaaagtaatcgaaaaacaaagaaaaggctactactccaaacaatacaccactcaataattctgtaatcaatacgaagaattttttcgtccgatacatttcaagaaaagggctccacaaaaatttcagtgtccaaggcatcataatcagagaagtccagaatgcaatttgcgtatccgaaattccaagatccttaaacatgaaaacagaaaccagattaatagcaataaagggaagtcccattgcaaaataagcagtaggtacccagcaagccgggttaatagtttttcgttgagaagcagttttattctgttgcataaatcatagtatatagatgaaaaaaaacgtttttctgacccatctatatataatacaactaaaagggggaaactactaacgtctcccccctactttttttattttattatcacttcgtctataaagaaccacgaaggatgacctacaccataatgccaagtcggacattctttcgttccggtgacttctactttcacataacgagtttttatcggttcggctgattcagccttgactccacggaattttacctcacccgtacgttcttccggtaaatcaattgttttccaatgcgtataatgttcaccgtcatcagcgtatgaataaaccacctttagaggaaaaagaatccaggcccctatttgatgaagaaaatctgtttccacactatgtatctctttcgcttcgcccaaatctataacgaatgcaccatcggttccttcccaaccaatccagctatcaacaaaggttgctccaccaaacaaaccgtcaatcagtgcgttctttcctaatgccgcatattttccggtaggaggaattagataagtaacctttgcacccaatgccaaacttttctctttttgtggcatgtaacgttccctgtacaatttacaatagtctaccggtgaattggaacgctcattcaatgtcggaacttgaaactctttcacgcgttcctcaaaaaggtctaactttttattgatatctaccaagtctttttctgtctccgttcgtgctatttccagttctgaatactgaattggcagacgtgcccgttgaactcgtttcaagaaaccaggttctgcttcaacggctttttcagccaaatcaaacaaatgattataacgacgcatcaaagcaggctttagcatgccatatttatgtgatacaggtgaatcatatatccacaacctctgtccactaccaattaatgctccttccattatctttatgtactgataaagatatggcgctgcttcaccataatatccatgcaaaaaatgttgcatcaatgagtctacattaacttctggattccacattaactttgacactaaataagcgcgaagttctgcaaaatctcctcccctgctccctgctatttgagagaaatgcatggtggcatgattctttttgaaaagacggatattgtcctgtaaaatatggaaattaggaaatggagccagataattatcaaagttaataccgtaatcccacacgaaaatattattggtaatcttagaccatccttccatggctttcacaaactcttttcccgaagcattctccgtcaaagttacttcacggtcacagtcaatatcacatagcataatattcacattcggcaaaggtttcacatgtttcggaggattcatagtatatagataagccaatgtggaaaattctttatccgggaaacgggcagccaacttattcagaaaagtgatgatacttcctgataatgctccttcataatcatcaattgccttacaagcatcacacgtacaatttgtataattaccatcattctgacttacagacatgatatgcttatctggatttgctttgaaaatagaatcaacacgttgagctacaatctcaaaaacctccggattactcaaacaccactgactggcctttcccgggtgacgttttcctttgaagtaagaataatattccggatgttctttcccataaatggatgaaggcagaagcttatcaaaagtatgcacccaataaccggcagcaaacacttcattcggttcctctaaacgattccaccacttataaatagagtctgtatggatagcataacattgtgtctgacggtaacgaaagcccggattctcgactttattaattaagggtaagttcactgtttttgaaggggcaagagaatattcattctctccccaataatcgatacccaaatattgctctaataaagtaacaaccccatatacaacaccgttttctttaccagatatttttagaataccgtcttgagtagaaatagagaatccgtcctctgttacttccgccggagattgaccaccaatgagaatatctccttttcgaggagtttgacttataacaacaggcaacttacaactggttactttttgaataaatgtttgtaacaaatttgcagctgtccacgatatttgattattctctttcaaaatgatcctagaacttgtattcccattagttactaacattgtttgagagagagacggaaatgccatactaattcccataaaccataaacagaaccgtagaataatagataatttcatgtttttcttgctattaaaagttattatataatagtaatacaatcaatatgatactattaaacaatcaacctttttctttttttatttattaacctatataataagtcccactttatccgaaaatacgaaaaagtgggacttaaaaattttcaataacctattaattatttcgcatataggtcaaattccgtaaggctgaccgtattgggaccttgtttcacataatactttaaataacgcgtttcaacggctttcgaaaacttaatatattgtgtgccacttcttgaaatagttacagcaccaatagatttccattttgctccatcactcgaagtaaatacttctactgcagtcggtgaataactactagcataacacttatttcttattcctgttaatgtctgcaccttacctatatccacagttaaccaatattctgctcctccatcacgagctacatcagaatttgttccatcaattagatttttagcatctccacgagtcgtcggagcaacttttacagtccagccagaacgatcggcaatcaaagtaccttcagccggttgcccggactctacattgacatgaatattttgaattttcacataaactactcctctgttagagctaagtgcatctaagttattaccttctatagaagatatggtaactggcaacaaatatcccccttctgtagtcaacgatcctacatttaacagctctatttttatagaatctccagatacactttctccattttcaatagtaacagttttattggtgaaagaataattttcagcaggtaatatgttatattccgtatcattagctttattgtaagcacttactagattatcatcactatcggctgttattttcacatctttcgataatctctccgtggcacatgcaacaaaccgataattaggttgtaactcatttacgaccactgaattatctttcaaaatcactgacaacgatgcttcataagaatctaccggaaaaactttcgtagaaagataaaacttagaattcacagtaacttcgtcatcatcgtcacaagagatgcacagtggtgatgccattaatgacatcactactgttttccatattatatttttcaatctcataattacatcatttgaatattatattatttaccatctgatctaatgccatctacccatctgacaactccattaggcgccgtggctttatttccatgaccagttgcgtctttaaactcggttcctgccccttcattcaatttccaataagcctccaagccatccgtacccggatttatcgcaaacatattattctgaatctgcgactgtgaaatagcagtagtccaaaaacgtacttcgctaactatagcatctgtaaccatccaatcaccattgcatataccaaagctattcttaacaagacgcaaaggttttcttggaagatctaatgttgcatcaatatttccatttacataaatagtcaatttcactccatcacaaacaaatgctaaatgataccattgattatttttaaacttagtagcagcatttacttgagtaccttgtgtttttatctgcaaaatattaccaggaatcgggccatcaccaaaacggatataaatttcaccatcttctgcgataccattacctggacctgcagaaaatattgcttgattctgatagctaggaggaccaggataaccaactccaggagtcaccccatccccaagttcgctcatattaatacgcatttcaagtgaccattgagttactgtataatcctgacgcatttccatagtaattggttttgtacccgtcaacactggtgcagaggttataataacctgatccatgatataaatcatcacatctgcaccttccaaagtttgttgcccacctgatacagcagtaatagcaaccggtagtgcaaatttatcaccagaatcaagcatttcctttgtcaacggatcaattgatactttaacagtaggagccactaattctcctttttttataaccactgtcttttgatcaaaagaatatgaaccttccggcatagatttatagttcgtaccactttttgtattatatacttccaacgatttcggacttagtcccaaagtaacttctatatcttttgttgcaatttgtcccgaccgaggagtcacagtgacaacactaccctcttcagctactgttacttttttagattcataagacaaactactggattcagctaaataaattctactgccgatagtatcatactttgcatcttcacaacttgctataattgcacaaagcaatatggcaaaggcgaacattattgtatttttattttttaccagatatctcataattattatatctttaaatttattattttaccggtggattcataatgcggatagcattacgcaaataaggataagattcttctgtaccatcaattgtatattcatactccatatgataagttccgccccctccttttacacattttttcccgtcaataataggcgtccaacgtgccataccttccaaagacttcattttatttccatatcgatctgtgaaatcagcaccaccagacaaagcccatttttcaaaattttcagttacaatatatttcttagcaacttcttctgcagtcaaatgcccatcgaagtttcttattgtagagtttaaacggctatccaaattgtcacgtccagtattatctcctggagaatcataagcctgcactataaaataattaaaataaggacctgactccgatacaatactttgtggctcaccgtcaattactaatagcctgtctgtacccgattttggtccgattctttctcccaaggtctgaatgaacaacaacatattctcatcacttccactcatgttacctcgatgaccaaaattaggctcatagtcaatatcaaagccatcatatccatatttatcaatactatcacatattgcatgggcatatttctttatagcttcttccttattctcattccatccccagaattccagataattatctttatattcctcgggagtcaattggtcaccgatattttgaacaataaaacacatcaaagctttagtcccttttacattttgtacataacgcaaatcttttgtttgcgcttctgtcaaatttctccagttaccccaaatagaaacaaaatccacactatcaggaagtccggctaaacatttttctaaagtagctccatttccggtccaattaccaaaccatccgaaagcaaccggatgatctgttttcttataagcgcgaagctgggcatagtattcttccggaagtgacgactgagtcatatcttcctggaattttggttccatgtctgtccaatcatcacacgctgtattcgcaaccgttatgccaaataacaacattataaaatagaatatctttctcatactatttatattaatatagattatactattattcacttatccctacgctgccaccaaaccttagtctgataattatcagcaccacccaatttacttacagcagcatttacattagcagcattacgaatatattccgatggtgggaacggaatacgattagctgaaggaagattggttacattcccattcaataacgggaaaaaacgcggatacccagtacgacgatactcactccatgcttcttgtcccaaaggccacattgcaatccatttttgggttattaatctttccagtttttcttcctcaccagcattatctttccatttgatagttatagagctaatagcactttcattccccttattctcattaggatctacataatcagcctgagtacttgattcatcattcaggtattggtcaataccatccgatactccccattgtgcaaaagaaagtctgatagctgattcatacaaatctttcaccgtttctccttttacatcccatcctaacattgccgcttcagctttattaaaagctgtttcagctgcactcatccataaagtacgatccatctctccaacatttattctagagaaagtcggtccggtaatatcattaccataagacaaacctgcgcgcatacccacataatcatcatctcctttatcgctcgttttctttttaaaatatttcgacatacgcggatcgttataccctttcatataggacgtaatatccgcagagacacattgatcgggccattgtaccaataccgtatacaattgatttttagtacctaaagaagttgcgttatcttcattggaagtaattacccctatagagtggttaatagcttcctccgccatctgtctggcatattcacgatctgcaaaacgaatacgaatggccatacgtagtttcagtgaatttgcaaatttcacccatttctcaaagtcaccgtcataaactttatcatacttagccatcgttctgttgtttggattttcggtcacataaacagtcattacattaattgcatcagtcagatcagtaaacatagcatgatatgcttcctccattgtatcgtaaggagccgaaagtttatcacttgaaatttgggaataaggaagtgccccatacatatcaagcatacgatgcattgtcgcaattctcaaaatctgtgcccatgcaaagttaactcctgttccttgggttacattctttattttattccatgcaccatacgtcaataccattacattatcatctgcaaactgccagtttaaccagttctcgggtgcgttatatgtagcaaaatttgcccctttaaacttatctgttgccattacttgataacgtccatagcagtcaccaatcaaggattcattggtattataaatgttttcagtagctatgggatatgcataatcacataaagtcaagaagaaagcattggcagcaaatccatctcgtccaagttcttcttccgaaacttttcccaacggatcattcaagctattatccatgcatccttgtaacattggagttccaacaagcatacagcctgcaatagaaatctgcgttatgaatttatatattttcatttggttattcttttatcgttaaaactgtatttttacattaaatccccaacttctcaaacttggttgcataaagtaatcaacaccttgataataagtaccagtagaagcggtagcttccggatcaaatggtgctttattataaatcatccacaagttgtgacctgttattgacaaactaagattacatttgttattaaaccatttggctggaagtgagtagcccaccgataactcttgtaaacgaacattagtagcactatatacatagttagacatcaatccacttattccacccacttctgtataataagtctggggatccacttttccattatttacaggaacaccttcattatcacgtgctaaagctgtgaccttagatactccgaactgatccattacagcttgtgttggtgagataacaatacctccaaagcgggcagcaagcatgaatcccaagctaatgcctttataagagaaatcatttctaaagcctaaattgctcttaggcaatacagagccaatatgaataaattcatccgaattctttatatcctctttcttcacattctggctcgctttatcaatatatacatttccttcattatcacgtttcaaacgattagtgacatacatgtctcccatgcttcctcctttacgaagaataactttagccgatccaatgccacctttatctatctcactcaaactatagtgattaccttcatcatccactgcatcatccaagagttctacaatcttatttttattaaaactaaaagtcaaatttgaattccacgagaaatctccccatgatttattgtaccctaaagaaaattccatacctttattctcaatattaccagactgcgcatacatagtcgcatatacagcggttcctgataaaggaacttggaatgtttgtttgcgagtattagccttataccaggtaacttccaaacttaaactattattaaagaatttggcattcaaaccagcttcccaagaattagtacgttcaggataaagtttaggcaaaggacgataagtttgtaatttccattgactagtcgcagggtcccactcatacgttttgttggaagaaagattcttaggaataggagcacctactgaagcaaatgagccgcgtactttcaaataagtaatagctttgggtaattttaccatttcggaaataactcctgaaagccctattgatggataaaagaaagatgattgttctgtattaatcaatgctgaatcccaatcattacgtccggttaaagtcatatacaacatactcttccaaccaatttccgcactagcaaaaatagagttggtgcgttgtttgtatccactttctataggataagtatctttatccaaagttgtagtcatattatatagactaaaaacattagacatatctttcaaaccaccttggaatcctctttcgtcataataagtttgagtaaaactaccgccaatattagcacttaaacttaagtcaccaaagcgtttattaatattagccatcacatctgcataagcctgtctatcgtcagctttatagtacttatagaatccataaatagaactattagtaaagtaaagatcagtagaagcatttcttttatctgaataatcattggttgcattatcaatgcgaacgcgccctgtcacatcaagccaatccaaaatttcatattttaaactagcattagccatgtaacgttgttttttcatgccatggttcatctcattagccacccaatatggattatttttcatactgtatccagggtccccccatccccagttctgtacatctatcttacgagttgtgtcatacgttttatacatcctcacagcttcaaagttttcgccacgcgggaacagatatacagctggtagtggattgaaatattcaccttgtgccattagattaagatcttcttgaataatatagctaaaacccacatctaatgtcattttatccttcaggaattttgttgtatttctgaaggtaaaattgtaacggtcatatttgctattttgaatgataccagttgcattagtagtacctacagacagataagtttgattcttttcattaccaacagataaagaaacgttattctgaatattagtacctgtattgaaaaaatcttttggctcataagttccgaaaagggaagacgctttatctccccatgaagcaaaggaacctgcgcggtttatataagaattttggaattcaggcattataaaaggattggaaaaagtagaattattagaaataataattcgtgccttaccttcttttcccttctttgtagtaattaaaattacaccagacgctgcattagagccatacaaggccgcagcagcaggtccacttaatacagacatgctttcaatatcttccggattgatatcagatataccctctcctctcggttgggctgaatattgtccgttagtgtcacctttatttgtattaaaaataggaacaccatcaattacatataaagcattattgtctgaagatatagatttggtaccacgcataactacacgcgtagcccctccaacaccggatgaagatgcattgatattaacaccagccacctttccagccagtgagttcataaaattggcactttttacagttgtcaattcatcaccttttacttcttgcacattatagcttaatgctttagttgcgcgcttgatacctaatgcagtaacgactacttcgtccaacacctgcgtatcttctcctaaagtaaccttcaagggttgtgcactagtaagcgtgattgcttgggaggcataaccgatataggatacttcaagtacatcacctttagctgcttgtattttgaaatttccatccatatcagtgatagtaccatttgaagttccttttaccaaaatactaactccaatcaatggttctccttttgaatcagtaacagtaccacttgcagtaattggtgtttttttctgctgctcttctttattactcttcgcagaaagtacaatatgattatctactattgaaaaactgacatttactcctctgaataactgattcattacattattcaaagattcttttgttaccttgatagatatgacacgatttatatcgacatcatttgtgttatagactactgacattgaagtttgtttctcaatttctttcaaagcagtgttcaagggtactttcgatagattaagagtgatcgttcgttcttgcccataagctgaagcaaaacacgaaaccaacaaaaggaagaataacaagtatgaaaacttgtgttttataatttctttcatcttattctttttaattagaaatagtttttagagaatttgtaattagaggcggtaaatgagattaccgttttcacacaaaggtttcatgtatctctgtttctcataattaataaatttaaaggttatacttaaaataaattccataagcgcttattcaatagtaatacattttatgttgtaaccttactaaacgaagataagatttttttcgaaaaaaatagaatagaaagattcctaattgaaaaataaatactcaaatatttgataaatagaatcttatgtacttattaaaatcaggctgatttattacatttgcatacattttgcatacaatatatgtatgctttacctattgtatagatataaatattcattttatgttcaaatattcaaaagatggaatttcggttttaaccatattagataccagaagagcaaaaaagagtggacagtttcctgttaaagttcaagtggtatatagaagaaagcaaaaatattactcaactgggaaggaagtgtcaaaagaagattgggcaaggttattaaaggtaaaaagccggttattggcagaaattcgatcagatatagagagtagtttttcaactattaagcaacaagttaatgaactgataacaaaaggagaatttagtattgaaacattaagcgtcaggttaggaaggcagatgaatgatatgactttgcgcagtgcttttcgcttaaaaatgaaagaactggaagcctatgaacaagcaaacacttacctaaattatcaaagtgctttaaaaagtttagaagatttcggaggttccactatacctttggaaaacattacaattgattggcttaaacgttgtgaaaaattttggatgtcagaaggtaaaagctattcaagcataagtatttatttccgagctttaaagtgtgtcttaaatcgtgctgtacatgatggtattataaaagaatcatcttttccttttggaaagaataaatatgaaattcctgaagggtgtggacgtaaattagcacttactctttctgaaataaaaaaagtaatgtcctatcaatgtgaaacaaaagatatagaagaatttagagatctctgggtgttttcttatttatgtaatggcattaattttatggatttattatttcttcagtattcaaatattatggatggagaaatatgctttgtacgctctaagacatctcgaactaccaaacataacaaagagatacatgcaatcattactcctgaaatgtggaatattattcaaaaatggggtaatccaagattaagcccgcaaacgtatatttttaaatatgctagaggaactgaagatgcctttgaaaagattagattggtacggcgtattataaccaaatgtaacagaagacttaaaaaaatagcccaagacattggaatttttcagttgacgacttacacggcaaggcattcttttgctacagtattaaaacgtggaggtgcgaaaacctcatatatttctgaaagcttgggacactctaacttatctgtaaccgagcactatttagcatactttgaaaaagaggaaagaataaggaatgctcaattattgactaactttaatctctagattaatacatttgcatgcaaattgtatgtacaatgaaaaatggaccaataattgatataggataaaagtgagtataatattaaaaaacgcatattcagattatctataatttagaatatgcatcttgttatcaggagtgtttcgaaaaccgcagggatttccactttagccaaacgtaattcaaataaaaaaaaggatgatattattgcaatttattctttttatcgcccgcgtagtgatagaataatatctaatattgataatattaatcaaatgaaaagattccgttctttgtattatcggcactaactagaagaaaacaactactataaagcaagttattattattctttaaatgatttgttaggttccatttaaagaatcaaaatgttccacaccgagaaacgaagtgattctcggtgtggaacattcctgaaaaaacgtcttttatcgaatattcataccgcatatatgaataaaaacaagttgattactgcatattcatgcgcaatcttactaactttttctctcattcattgaatttacttaattgtatttagtctgacatcttaaaaatagaacatctaatctatttatcaaacaagaatagaatttagggaaagtatatgaaactgattttctcccaaacaatcacgcttgccaacgcacaacctataaaagtaaccttaggagaagatacgcaagtattggacgaagtagttgttactgcattgggtatcaagcgtgcaactaaggcgttaagttataatgtacaagaggtaaaaggtgacgaattgacagctgtaaaagatgccaattttatgaattcactatcaggaaaggttgccggtgttcagattaatagtggtgcaaccggtgctggtggtgccacacgtgttgttatgcgtggtatgaaatctctgactaaagataacaatgcattgtatgtaattgacggtgtacctatttttaatacaggaaaaagcggtggcgaaggattatttggagagatgggaggatcagatgctgttgctgacttaaatccggacgatattgctagtattagtatgatgaccggtccttctgcggcagcattatatggttctgctgcggcaaacggtgttgttttaattactactaaaaaaggccaaacagagaaaactaccataacagtatccaacagtactactttctctaaagcatatattatgccggatatgcagaaccgttatggtacaagttccggattattcagctggggagaattgacaaaccgtcgatataacccatctgacttctttgaaacaggctccaatgttatcaattcggtagcattatctacaggaaataccaaaaaccagacctatctttctgcttctacaactaactccggtggaattcttccgaataactcctataaccgttataattttacggcacgtaataccacccatttcctgaatgataaacttactctggatatcggtgcacaatatatcgttcagaacaacaaaaacatggtttctcaaggacagtattataatcctctcccatcactgtatctattccctcgtggagacaactttgacgaaattcgtctgtatgagcgttataatactaactacggctatatggaacaatattggccttatggtgatgcaagtttgtcattacaaaatccatattggatacaaaatcgcatcaaccgtacttccaacaagaaacgttatatgatgaacgcttctttgaaatggcaggctgcagattggctcaatgttgtcggtcgtgtcaatctggacaactccgactaccggaataaaaacgaaaaatctgcttctacattaacaacattctgtggtgtaagcggtggttttgaagatgccatgcgtcaggaacgttctttatatgccgatttcctggctaatatagataaaacatttggtgattttcatttaacagccaatgttggtgcttccatatatcatacttcaatggatcagttatatattgcaggtgacctggttattcctaacttcttccagatcaacaatattaatttctccgccaactataaaccggaccctaccggatatgaagatgaaattcaaagtatttttgccagtgctgaattaagttggaaaaatcaactgtatctaaccgtaaccggacgtaatgactgggattcaaaacttgcattctccaaacagaaatctttcttttatccgtcagtcggtttatcggctttattatcagaaatggttaaactgcccgaggtgatctcttatgctaaaatacgcggttcatatacagtggtagcctcttctttcgatcgtttccttactaatccgggttacgaatacaacagccagacacataactgggcgaatccgaccgtttacccgatggacaacatgaaacctgaaaagactaagtcctgggaaatcggtttgaacttgaaattctggggaaaccgtttcaatttagacgcaacttactatcgttctaacacactgaaccaaacatttaaggtagatattccctcttcttccggatataaacaagcgattgtacaagctggtaacgtgcaaaaccaaggtcttgaattggctttagggttcaacgataaatgggcaggattcggatggtcttctaatgcaaccttcactctaaaccgtaacaaggtgaaacgactggcaagcggcagcgtgaatcccgtgacaggagaagctatccaaatggatgaaatgaatgtgggttggttaggtaaagagaatgtagctcctcgcgtcatcctgacagaaggaggctccatgactgatatctatgtatacaaccaactgacaaaagacaataacggtaatataaaagtcgatcagaatggtaatctgggtatcacttcatcaaacactccggtaaaagtaggtaatctggatgctgatttcaacctcggatggaccaatcatttcacttataaaggaattgatttaggagttgtattatcagcccgcgtaggcggattagcttattcggctactcaaggtatcttagattattatggagtatccggaacatctgcaacagctcgtgataatggtggtatacctattaataacggtaaagttaacgcccaaaagtattaccagactattggtacgggtgaaggtggctacggtcgttattatctatatagtgcaaccaatgtacgtttgcaggaattgagtctaaactatacacttcctaaaagatggtttaaaaatgtggcgaatgttactttgggtattgtaggacgtaatttatggatgatttattgtaaagccccatttgacccggaattgtctgcctctacctccagtaactattatatgaatgtagactactttatgcaacctagcttgcgtaacttcggttttaatgtgaaagttcaattctaaaagaaaaagctaatgttatgagaaaatatttaagaaatatcacagtcggtgccgctctgttgttactggcaggaagttgtaccgataaatttgaggagtataatacgaatcaatatcaaattcatgatgcagaccctgcgactttgatgaagtctatgattgaaacaattgtgaatattcagcagaatgactctcaaatgcaagatcagatggtgggacagttaggtggctatctatgctgttctaacacatggagtggtacaaacttcagcacattcaatcagagtgatgcctggaatgctaccccctggaacactccgtttgaaaaaatatatggaaactttttccaaatacaggaagcaactaattctacgggacattattatgcttttgcgtgtatgatacgtgcaataacgatgcttcgcgttgcggattgttatggaccgatgccttacagccaagtaaagaagggtaatttctatgtatcttatgatacccaggaacaggtctataccagtatattaagtgatttagccaatgcagctgatgttttgtacaactattatgtagaaacaaatggcaatgccccattgggggccaatgatccggtttttgatggaaattattcaggttgggctaagctagccaattcaatgcgcttacgtgttgcaatgcgaatcagcggaacatggcctggcattgctcaagaggcagctgaagcagcagtaacacataaagcaggattgattgaaagtaattcggataatgctatgctttcttgtggcacacagagtaatccatatcaactggcagctgtaagttggggtgatctgcgtgtgaatgcaaatattgtagattatatgaatgcatatggcgatccacgtatgccgaagttctttaataagtctacccttgccgggaaaacagataaatatgtaggtatgcgtacaggagatgctgattttaaaaaggcagacgctgcaggattttctattcccgcatatacggcaacctctaaattaatggttttctgcgctgcagaaacggcttttttacgtgcagaaggaaaattgcgtggttggaatgtcggttctaaaacagcaaaagcctattacgaagatggtattaatttgtcaatggaacaatatcaggtttcagccactgaatacttgaagattgacgaagctcctgtcgtatcacatgaaagtgatgctgtgcaaaatgctactgctacaattaccaatacagtgagtgtgatgtgggatgacagtgaggctgataacgtaaatggaaaaaatttccaacgtgtcattactcaaaaatggatcgccaattatccattaggattggaagcatgggctgaatatcgccgtacaggttatccggaactttatccttgtatcgacaatctatcagattgtggagtgagtagccaacgcggtatgcgtcgtctaagcttcccttatacagaggcacaaaacaataaagccaattatgatctgggagtagcagaactaggcggtgctgataacgaagctactgacttaaagtgggctaaaaagaactaatttatataatgcataaaaaggacttttatgaagaaaatttatttattatacattgtactcatatcactggcaacgacctcattgatcggttgcagtgactggacggagtcggaagcaaaaacttttcccgaatcgatcgtatcggatgaatattatgcggccttgcgtgcctataagcagacagatcaccaagttgcctttggctggtttggtggctggagtggtgaaggtgcctatatgaaaagctctttagccggtattcctgatagtgtagatattgtttctatttggggaaattggtcgaacattacagaagctcaaaaaaaagatctgcaattttgccaacaagttaaaggaactcgttttaccatgtgttttattatcagaagtgtaggcgatcaaattactccgcagaatattcgtgaaaattgggaaaatatgggattttcatccgaaaaagaagctgtgaatgatttttgggaatggccttccgatgaatcaaataaggaagcaatagaagcatccattcgcaaatatgcaagcgccattgccgatacagtaaacaaatatggttacgacggctttgatatcgattatgaacctaatttcggcaaccccggtaatatcgtagacgaagacgatagaatgtttgcatttgttgatgaactaggcaaatatttcggtccgaaatcaggaacaggtaaattattagttatcgatggcgaaccacagagcataacaggtagacctgaagtcgggttatattttgactattttatcattcaggcttacaataatagtagtcctggcagtgattctaaactcgataaacgtcttatcacaggcggcgtagcaggtgcaggacttgttcagacgtatagcagtgtcatgtctgaagaacaaatcacgaagatgaccatcatgaccgagaatttcgaggctactgatgctgctatggacggtggatatgattacactgatcgttatggtaacaaaatgaaatctctcgaaggaatggcacgctggcaaccaagtaacggattccgtaaaggtggtgcaggaacctatcatatggaagcagagtatggaacttcaccagaatataaaaatatacgccgtgctattcaaattatgaacccgtcatcacattcattacttaaaaattaatgtaaactatgaaacgtatgaattatataaaaattttatgcttctccgcagtcataacaggcttaggaagtatagtaagttgtggagatgcaaaatacgatactttagatacacatgcttatattgaagaagctctttccagtacaagtcaaaaagtgaccgtacaggctactggagaaagttttactaccctaaatgtgcatcttagtaatctttcttctacagacaatcattataaattggttacagatcaatcagtactggacacttataaccatattaatggaaccggatatataatgttgcccaaagattattatacgttgccggaaacgattactgtaaaagcaggacaatatgcagccgatgccctctccatcgctttgaaagctttcagtcaggaaatgatgaaatcgggagaatcatatgcactgcctgtaaaactagtattgcaagatggaagtatttcaccgatggaaaataccggaacctttgttattttggcagaaagtattatcgaattttcagctccaatgtttgttggcgctcctagtttaaaagctaataaattcacagaatctcccgaaacgtattcacaatatacgatagaggttcgttttcaggtagccaacacagctgaccgtgaccgtgcagtatttaagaacggaggagatgatgcaaacttcatccttttacgttttgaggatcctcaaagtgacaatgaaaattataaggcacattcattagtacagattgtaggacgtaaccggctttatttgaatccaagtaattctttcaagccaaacgaatggcaacatttagcattggtctgtgatggttccaactatcgactttacataaacggagttgattcgggtgtgttgagtataccaacaggagcaacaactttctctgatgtaaattggttctgcttaggtgatgattcttatagtagatggggaaactgtaaaattttgatgagtgaagcacgtatctggtctgtagttcgttccgcttctcaaattcaaaataacatgactcaagttagcccaaaatctgtaggtttggaagcttattggcgattcaatgaaggacaaggcaatgtattcgaagatgcaaccggcaaaggtcatacattgactacttctgctactcctacctggattgacggtattttatctacagataaatctaccgaatggaaatagtaataatttaatcgtatgtacatatgaaaaatatatttcaatcactatcaatagcaactctactcggcttgtttgtcccgttcatttcgtcctgtagcgatgatgaagaagtttttaacgaatggaatgctacgtatgtgtctctacagagaaatgactatttatcggggaatgtaaaaaagttcaatctgactcatgatgcgaatggaatcggaggagatgaaattaagatggcttttactgtaaaaacacagaaagcagtctctacagatatggttatcgtattaagtgcaaaaagtgaaacagaagggcttgatgcaagccagatcgttttaagttcctcacaggttactctcaaagaaggacagatgacttctgaagaaatcactgcgacggttgatccgacgatatttgccagtatcatggaaaaaacaagtttctctttcagtgtctcaatcagtaatgtaactaccaatgataagaacactgttattagcagtagtttaagtacattgcctgtcattattaataaagctgcctattgtaatctaaaaagcggtattcctagtaatagccaacttatcagtaatcgcgccggctggattattaatgtagaagaaggagtagaaggcgcacccaataatttaatcgatggcaagactggaactgacgttgctctaaataataaaggattctggtttactgttgatttaggagaagctaaggttttaacaggtatcaaaacgaatcattgggccaatgcatatgctcctagagaagtggaaatattacaatctgaaaatggtacgacatggaaatcttgagttcattagcaatctccggtggtacacagaatattacgttcatttctcctattactacgcgatatctgaaatatcagattattactatctctacaaacggtcgtacggatgttacagaatttaatgtttacgaacccaaaagtgagtaagtatttatgaatagataactataaaaatatagaatagaggctatcaaacaggccttaagttcataaaatcaccctcattacaatgaactgcaccccaaaagttgaacacaaaacttaaggagtgcagttcagtcatgtagtgagggtgatttctcgttttaaagactatctaatcaaatccctttccaatcagtttgccactacatatatgtgaaatgcccccagaaagttatgtatctaacttttgggagcacttcacatctttatataacgaacaaaccttaatctgtcaagatctaattagacagccttttagaaacactaacctatcttttatttcttcatcactcggacaatccgtccgtctttcttgtaagagaaatgattagtatgcattaaaacattcagtatttcatcagcagtgctatcagtagagaattcaccggtaaaccgttctgatttcaatgtttcatccttatagataaatttgatgtcgtacaacttctccataatattggttatttccaataaagattgttgcttaaattccaacttgccattaatccagagaagcacatctgtaggctggttatattcaattaactctgcttgataagtatccgtattcacattcaatgtctgtcccggtttcaacaaatagccattctcttccgttcgcggagaatctacccgtaccagtccttgaagcaaggtagtcactaccctattctcatcttggcgtgcacgcacattaaatttcgtaccaagcacacaagtcttgatttgcttactatttactataaatggagcatgtttatcatgagacacttcaaaataggcttcgcccgacaaatcgatttgacgatccgaactccagaaagaattatgataaacgatttttgaagatgcattcagccataccttactaccatccggcaacacagtctgcgctctctgtccggcagcagttatcacctcataatccgaaagcttattagaaagtaatccccaggcaattccaccggcaaaaacgagtccggtaagaaaagcagccgccacagttgcataacgtccccaacggatcgatatacttttccgcttagcttttttctccttttctctgatagctgatttaaattgatccaatgacgcctctgtatctacagtattcattaccgctatacgctcacctacaaaaagagtgtaataaagttgctccaaagctttccggttttccggtccttcctcgcaccaagcttccacccgggcagcttcttcatcattacattcgccttgcaggtaattcaccaagatagtttcatccatgctcttttatctttttacaaaaaaaactataatacctttgtagtaatacagttgtgagtacaaatatactaaagagaaaaagaaaaaaatattttttctcgcatttttatttcatttatctacttctttcattatttttgtcttacataaattaaaagagaatgtcacaatctccgatatatttggatattaataataataagtccgttatcactgccctaaaagcaggagaagaaaaagtttttgacgtcgtctacagacattatttccgtaggctatgtgctttttgttcccagtatgtaggtgagcaggaagaaatagaggagattgtacaagaaacgatgatgtggctgtgggaaaatcgttgcactcttatggaagagctgacactcaaaacacttctttttacgattgtcaagaacaaagctctcaaccgtctttcccattttgagatcaaacgaaaagttcatcaggaaatcgttgataaatatgatagtgagttcaataacccggacttctatttgagtgatgagcttttccgtttatatgaagaagcactaaaaaaacttccgaaagaatatctcgaagcttacgagatgaaccgcaatcaacatctgacgcataaagaaattgccgagaagctgaatgtatctccacaaacgattaattacaggattggacaagccttaaagttattgcgagtagctttaaaagactatctacccttattcatacttattttcggacctaattttttcgaacaatcatgaaatcaaaattcgtatttagtagttcaagcctgtttatcggacttcttcttttcttcttcactgaaaacgtgtgttcacaagaatccgctgataactggactcttaaacaagcccgtcaatggacacaaaaacaagaatgggcgaacggattgaaggcaatgcctcataaaacgaccgattatcaggaatttgcgtcacaatatcataagaacaagaaagtatgggacaagactttccaatggctagctacccacgaccttgtgaatatgcctgccggacgatacgaagtggatggcgaacattgttacatcaatgtacaggatgcaacaacgcaagatgtcagtaaacgtaaaatcgaagcacaccgccacggcattgatctgcaatatgtagtaaaaggcaccgaacgtttcggaattacttcagcagaatatgcagagcctatcaccgaatacaaaccggatgttactttctacaaagccaagaaaataaaatatgtagattccactccggatacattcttcatgttcttccccaaaaactttcatcaggcattggtaaaggcagggaaagaaccggaggacatacgggtcattgttgctaaaatcgaatatatcccataaacagaaacatgagtgaacttttagtctataaagcctccgcaggttcgggtaagacatttaccttagcagtggaatatatcaaactgttaattctcaatccccgcgcctaccggcaaattctcgctgtcacctttaccaataaagcaacagcagaaatgaaagaacgtattcttagtcagctttacggcatacagataggcgataaagattccgaagcctatctcaaccgaattaaagaagagacaggaaaaaccgaacaggagatacgggaagcggcaggcgtcgcccttagctatatgctgcatgattacagccggttcagggtagagactatcgactcattttttcaatctgtcatgcgcaatctcgcacgggaactggaacttagcccgaatctgaatatcgagttaaataacaccgaagttcttagcgacgctgtagatagcatgattgagaaactaggacccacttctcccgtcctcgcatggttgctcgattatatcaacgagcggattgccgacgataaacgttggaacgtatcggacgaagtaaaaagtttcggacgcaatattttcgatgaaggttatattgaaaagggagaaggactccggcaacggttacgaaaccctgataccatcaaagagtatcgcaagcaactgaaagcgctggaaacggaaattctggagcaaatgaaaggattctacgaccaattcgaaggagaactggatggacacgcactgactgctgatgatctgaaaaacggttcacgcggaatcggaagttattttcgtaaacttaataatggtattttaggcaatgatatccgtaatgctacagtagaaaaatgtctggaagacgcaaagaactgggcaaccaagacttctccccgctacgcggacatcattaatttagccaactctagtctcatgcaaattctggaagatgctgaaaagttacgttccaagaataatttgttactgaatagttgccgattatccctgcaacatctcaacaaagtgcaactcctcgccaatatcgatgaagaagtacgtcagttgaatcacgacaacaatcgttttctattatcagatacgaatgccctgctccatcaactggtgaaagacggtgactcctcttttgtattcgaaaagataggaacgaatatccataacgtcatgatagatgagtttcaggataccagccggatgcaatggggaaatttcaaattgctcttactggaaggattgtctcaaggagcagacagtttgattgtaggagacgttaaacaatccatttatcgttggcgaaatggcgattggggaattctcaacagcctgaataatcacatcgaacatttcccgatccgcgtcaagacattagctaccaaccggagaagtgaaaccaatgttatccggtttaataaccaaatcttcacagctgccgccaactatctgaacggagtatataagcaacagttaggcaaggattgtgaggatctgcagaaagcctatgccgacgttttgcaggaatctccccgaagtacagaaaaaggatatgtaaaagtctcttttctcgaacccgacgaagaacatggttataccgaacagacattaatcagtctgggagaagaagtgcaacatctcctcacctccggagtacgactgaatgatatagccatcctggtacgaaaaaataaaagtattccccgaatcgccgactacttcgataaggagctacactataaagtggtatcagacgaagccttccgccttgacgcctctcttgccatttgtatgatgctggatgcactgcgattcctttccgatgaaaataataaaatagcacgtgcccaactggccgtagcctatcaaaacgaggttttacagaaaggactggattggaatactctcctactcctccctgccgagaattatcttcccgccgcttttcttgaaaagacaaaggaactaaggctaatgcctctttatgagcttttagaagaacttttcagcatattcgagatgaatcttatcaaagatcaggatgcttatttattcgctttctttgatgcggtgaccgattatctgcaaagcaactcttccgagctagacggattcatccggtattgggacgaaacattatgcagtaaaacaattccgagtggagaagtagaaggtatccggattttctccatacacaaatccaaaggattggaattccataccgtactccttcctttctgcgactggaaactggagaatgaaaccaataatcagctagtatggtgtgccccgcaaacagcaccattcaatacattggatattcttcctattaactattccacccaaatggctgaatcgatttatggtaacgactacctgcaagaacgtcttcaactttgggtagataatctcaatctactatacgttgcttttacccgcgctggaaaaaatctcattatctggagtagaaaaagtcaaaaaggtaccatgtccgaactattggcaaacaccctaccgatagtagcccaagaagaagggattgactgggaagaagactgttacgagcaaggacaactatgctcttccgaaaaagaaagaatcaagacatccacaaacaagctaacccagaaaccagagaaactccctattcggatggaatccatgcggcatgatattgaatttcgtcagtccaaccgctctgctgacttcattcagggcattgaagaagaagattcggacgaccgctttatcaaccgcggacgtatgttacatactttattttctgtcatcgaaactgcagaagatatcgatccagccattgaacggcttatttttgaaggagttatcagaaatgatgagaaagaaaaagtggctcgtgaagttgcaaagaaagctttttcttctcctgaaattcaagattggtattccggaaaatggacactctttaatgaatgtgctattatctataaagaaaaaggagttctgcaaacccgtcgtccggatcgtgtaatgatgaaggacgatcaggttgttgtagtcgatttcaagtttggtaaggaaaatcctaaatataacaaacaagtgaaaggatatatgcaacttcttaccaagatgggatataaaaatatcaccggctacttgtggtatgtggatgaagaaaaaatagaaaaagtatgaaagctgttcctctcatcggcattgcccgccatcgactaacgattgacggtgaaggagttacaacattagttgctttccatggctgtccgttgcgttgcaaatattgtctcaatccgacatctttgcagcccgatggtgtttgggagagctatgattgtaaccagctctacgaggaagtacgcaaagatgaactttatttcctggcgagttgcggaggagtcacatttggcggtggagaacctttgttacaaagcgaatttatcaggcaattccgccaactctgtggcccagaatggagaatcactgtcgaaacctctctcaatgttccgcaacagaatgtagaagaactgatttctattatagacaattacatagtcgacatcaaagatatgaataataacatctatcagcgatataccggaaagaataatgaaaacgtcttaagtaatttgcgatatttaatcgggaaagacaaagccaagcaaatcgttatccggacaccactcatcccttcctataatacggagaaggatattgaccaaagcatagaacttttgaaagaaatgggaatcacccaattcgaccgattcacctataaaacccctaatgattaatgccatggcaagaggaaaacaaacctgtaaaatcttaaaagagattcgtcagcagatagccgaagcgaatgatattgaattcattacctctgaatgtcagtatcagggagattgtttgggtacttgccccaaatgcgaagctgaagttcgatatttggagcaacagcttgaacgaaaacgccgtgtaggtaaggccatcactctgtttggactatcaactggtatacttacaataatacctcctacttcattggacgcagaaacactgcaatgccctaaaatgaattggaccattactgctgacagcctgatacaagaaaaagacatgaaaggggaagcccccttttatggtccggaaaagctaccggaatttcccggaggaacagaaaaatttatagaatttctgaaagaaaatcttcgttattcagaaatagatagtattgctaataatacatacactgatgtaaaattcactatagattataacggacaagttatcaaccctaagattacccgcaagatacaccccaaagttgaagctgaaatattaagggtcatgtctctcattcctcgttggacacccggcatattggcaaatgagacagtacaagtgacatacaatctgatgctttcattcagtgcgatgtatggcccggaattgagaatcacttatactcgtataaactatcctgacgtttacgagaaagtacctgttatgcccgattttcctgaaggccagcaagctctcatggaatttcttgcaaaaaagattcaataccctaatacaggaacagaaggtaatggtgtacaggggcgtactattattcagttcatcgttgataaagaaggaaatatagtcaaaccaaaagttttacgtggcgtagatccttatctggataaagaagctttacgcgtcattaatcaaatgcctaaatggaaaccgggagaactggaagatggtactaaagttgctgtttatttcaccgtacctgttatgttccgattacaataaatacaagaatcagaaaatagtttaatcaatatgcaatcatttctccaactagtcgctcatgatttatataccaagataggaaacgacctgtcacgtacggtactcgttttccctaataaacgtgctaacttgttcttcaatgaatatttagcaggagaatccgataaaccgatctggtcaccagctgccatgagtatcagcgacctgtttcagaaactatccgtacagaaaagcggcgatcctattcgattggtctgcgaactttataaagtgttcaaagaggaaacacggagtcaggaaacattggacgatttctacttctggggcgaattgttgattagtgattttgatgatgtagataagaatatggtcgatgccgacaaattattcagcaatctacaagatttgaaaaatctgatggatgactatgaattccttgacaaagagcaggaagaagccatacaacagttttttcagaatttctccattgaaaaacggaccgaactaaaagaaaaatttatttccctttgggacaagctaggtactatctaccatcgttaccgtgcgaacctgacagagttaggcattgcttacgaaggcatgctctaccggaacgtgatcgaacaactcgataccgaccaactcaaatacgacaaatacatatttgtcgggttcaatgttttgaacaaagtagaaagtgactttttcagaaaactgaaagatgcgggcaaggcactcttctattgggactatgatatcttctacacccaacaaatcaaaaaacatgaggccggagaattcctgaaacgtaatctcgaggaatttccgaacgaactcccggaaagctttttcaacacctttaaagaaccgaagaaaatacgttatatttccgcttctaccgagaatgcccaagcacgtttccttcccggatggattaaggcgataacaaacgatcattcacaaattaccgtagaaaaggaaaaagaaaatgctgtagtgctttgtaatgaagctctgttgcttcccgtacttcattccattccgcaggaagtgaagaatgtcaatatcaccatgggattcccattggctcaaactcctgtttatagctttatcaatgccgtaatggaactgcaaaccaatggttaccgctccgataccggccgattcacttacgaggcagtatccgccatattgaagcatccctatacccagcaattatcatcccatgccggtcccctggaacgtgaactgacccaaacaaaccgtttttatccacttccgtcagaacttaaacaggatgattttctaactaccctcttcactccccgtaatggtataaaagaactatgcgattatctgatcgaattaatcaaaaacatttcaaccatttatcggaaagaaggagaatacaatgatatcttcaatcaactatatagagaatcgctctttcaaagccataccaaaatcaaccgtctctacagtttgattgaaagcggagaactaaatatacgcaccgatactctgaaacgactgattaccaaagtactgacatcttctaacattcctttccacggagaacctgctatcggaatgcaagtcatgggagtattggaaacacgtaatctggacttccggaatctcattatattgtctctcaacgaaggacaacttccaaaatccggaggagattcctcttttattccctataatctccggaaagcatttggcatgaccactatcgaacacaaaaatgcagtgtatgcctactacttttatcgactgatacaacgggcagagaatatcacgctactctacaatacttcttcggacggtctcaaccgtggagaagaatcccgcttcatgctgcaattacttgtagaaggtccacatgatatcactcgcgagtatctggaagccggacaatctccgcaaagtacccaagagatacgagtagaaaaaacacctgaagtactaagacgaatctatcgtgcttacgatagcactcatccaaattcactggttctctctccttccgcccttaatgcttatctggattgccggttgagattctactaccgctatgtagcgggcttgaaaacaccggacgaagtgagtgctgaaattgattccgctctattcggaaccattttccacctctccgcccaattagcatacaccgacctgactgcaaccggaaaaacgatacagaaagaagatcttgaacgcttattacgcaatgacgtgaagctacaaagctacgttgaccaagccttcaaaaaagaattattcaaagtttctcccgaagaaaaaccggaatataacggcatacaacttatcaactccaaagtaattgtttcctatctgaaacaattgctgcgtaacgaccttcaatatactcctttcgaaatggtcgctatggaaaagaaagtttcagaagagattactatacaaacaggacaaggaccgttcactctccgtctgggtggcacaatcgaccgtatggatgcaaaagaaagtaccctgcggattgttgactacaaaacaggaggaagccctaaaatacctgctaatatcgagcaactgttcaccccatcggaaacacgcccgaactatatcttccagacttttctgtatgctgctatcatgagccggcaacaatcgttaatggtagctcctgctctgctctacatccaccgggcagcatcggaaaactattcgcctgttattgaaatgggagaacctcgtaaaccgaaaataccggtaaacaacttcgctttctttgaagatgaattccgtgaacgcctgcaaacattattagaagaaatattcagcgaagaagagccttttacgcagacagaagatactaaaaaatgttcgtattgcgattttaaggctatctgcaaacgataaaccgaaaatagaatataccaattaaataagggcacaatttacatattcatgcaaaccgtgcccttattatttctagtcgtattatctatagttatcttatttctccaacaatggaattgagaaactaaatgtagacccgtctcccttctttgaagtaaaccaaagtttaccgccatttttgacaacaaagtcctgacacaataacaatccgagtcccgaaccttcttcattgtttgtaccaaaggtactgaaatgagtatcggtatgcagcaacttcttctgattttcgtcatcaataccgcaaccactgtctttcacacttacgattgccataccgtcttcttctgccagtgacaccactacttccgaaccttcattgctaaacttaatcgcattactgattaaattacgaatcaccgtcttaatcatgtcaatatcagcacgaacagccacattctctacaggcacatcttgtactatcttaatatttttcagactggccaccatcgtaaagatttcacttacgccctctacgacttccaccatattaatatcctgataaaccactttcagtttaccaatctggctcttcgtccatttcagcagattatcaagcaatgagaatacatcttctgttgtctgattagccattgtcagcaattcatacatctcatcaccaattgtttcgcttggcagattcagaatcagcatattcagcaccatcttgatagatcccattggtgaacgcaagtcatgtgcaatcacagaatagagtttgtcgcgtcccatgatcgtcttacgcaactcttccgtttgtgcaacaatgattcttttcgctgcaaccaacgaaatctggtgcgtcacacgaataatcaattcttctttattgaatggctttgaaataaagtcattaccacccacctgaaatccttttacgatatccgccgtactatttagagcagtcaggaagataatgggaatttcagccatttcggggtctgctttcatttgttgagctacctcaaagccactgatatccggcatcattacatccagtaatacaagatccggattttccttcttcacttgttccaacgcctgtgttccattaccggcagtcacaattttgaatttctcgttggtcaaaagtacctttaataaaaggacgtttgatattacatcgtccacaataaggactttatattcagaaggattaatttccatattcataattttctttttttatgcttcagacatttttaaaatattcaatcatacgcttcagcccctcttcaagttcaacagtaggctgccaacccagtttctctttagccaatgtaatatccggttggcgttgcttcggatcatcatccggtaaagacttaaatacaatcttcgaagatgaaccggtcatactaatgatcctttccgccaattccaataccggaaattcattcggattccccaggtttataggacctgtaaactcgtcctccgtattcatcattcttatcattccttcaatcaaatcatcaatatactggaagctgcgtgtctgcttcccatcaccatatattgttatatcttcattattcaacgcttgaagaataaaattagaaacaacccgtccgtcattcggcaacattcgcggaccatacgtattaaaaatacggataatcttcacacgcacattattctgacggtgataatccataaataatgtttctgcgcaacgctttccctcatcatagcaagaccggtaacctaccggattcacatttccccaatagctttccggttgcggatgaacgattggatctccatatacctcactcgtagaagcttgcagaatcttggcatccagtctcattgccaatcccagcatattaatggctcccatcacagatgttttggcagtttgaatcgggtcatgttgataatgaatgggagatgccggacaagccaaattataaatttcatctacttcagccgaataaggataagtgacatcatgcctcaccacctcaaaatgatgattatccatcaagtgaatgatattatctttcgaacccgtaaaaaaattatccaggcatatcacgtcgtgaccttcgtttataagccgagtacagagatgagagcctataaaaccggctccgccacttaccaatattcttttcattctaaatatttctattgtttactaaagagacgctgtctcttcgttttgtttatggtcacaaatgtaaccgatttgcttaaaataaacaattttcggagaggatattttaaaaaaaagcagatttaaatagtttcaatttccgaaacaacttgccactgacaaatgtttataatagaaaagtattatttattagaactattatgatgacaaataatccaaatgcaaacctcatagaagcgatgaaggaaaagcttccgctcaaaggacaactggcagatatgttaatggacacgctatacataggaaaagaggcagtatacagaagattgcgcggtgaagtacctttcaccttacaagagtcggctcttatttcaagaaaactgggtatatcgctagacaagattataggactaagtttcaaatcgaacgccatgtttaatataaacattgtagattatgacgacccgttcgagagttactacaatatccttgaaaaatatgtctcgctaatcaatacgatgccggatgacccgaattctgtaatgggaacttctgccaacattattccccagactctctatctgaaacatgaacttctggcaaaattccgtttattcaaatggatgtaccagaataaatatattgattgcaagagtttcgaagaattggatattccaccgaaactggtcaatatccagaaagactatgtagcaatgacacgtcatatccactccatagactatatatgggataatatgattttccaacaccttatcaacgatatccaatacttcgccagcatccatctcatttccgacgaaacaaaagaagaaatcaaaaatgaattattcttattggcggacgaactggaagaactggctatcaatggcaagacagccgatggcaatcgtgtacgcatctatgtgtcgaatatcaacttcgaggcaacatatagctatgtagacaccaataacctgcaactgagcctcatacgtatttattccatcaactccattaccacgatggacaacgaaattttctgtaccttaaaagaatggattcaatctctgaaaaagttctccactttgatatccgaaagcggtgaaatgcagcgtattcaattcttcaaacaacagcgagaaattattgacgctctttaattttattttcgtagattagaacttcaataaaaaatcagttccaataaatgaaagtagataagattcttatctactttttttcattccctgtcctcaccacttctgtttgattcccaatcagaaaaaaacacatacattcatctctgtttttccacacaaatctttcaaacacaagacgtaattttgcatagaatgtatcacagagattattaacattaaaattaaaggaacaaacaatgaaaaatggtattctaaacgaattaatatctacaatgagggagcgaattcctcaagatatgaatctggccaatactttggctgacattttatgcatgggaaaggaagctgtctatcgcagattgaggggtgaggtgtcttttacaatagacgaagtagcgctgctttctcaaaaactcggtatttctatcgaccagattgtaggtagccatgtatctaataaagttactttcgacctgaacttacttcatgccactagtgcgctggaaagttattacgaaataatcaaccgttatctgcaaattttcgactatgtgaaaacagataatacgacggaggtgtatactgcatccaattcccttccctttacactttattcttcctatgagaatttgtctaaattccgtctttgccgatggatgtatcagaatggggatataaagacgccacattctttggaagacatgtctgtggatgaacggatcgtcaatgtgcataagaagctgagtgaaagtataagacagtgtccaaaaacgtttttcatctgggacacaaatatcttttattcttttgtgaaagagatcaagtactttgccagcctgaatctgataaacaaggacgatgtcatgcatttgaaagaagaacttcttcagttacttggcgtggtagaacatctgtccataaagggagagttcagcgaaaacaagaaagtgtctttctatctgtccaatatcagtttcgaagccacttacagctatatcgagaaacatgattaccaagtcagtctgctgcgggtatattctatcaactcgatggattcgcaaagctcatatatctgccagatgcaacgcaattggattcaatcgttgaagcgccactctattctggtttcggaaagtggagaagcacagcgtattgctttcttgcaaaagcagttggaagttatcaatacgttgtaaacaaagggaaacacactaaacattgtggattctaggaataaaaagaaaaggatttaatagacgagctgtatcagaatgaagacaaacaacattctgatacagttcttttagcttttattctattgtgcgcacacaacgataccaagcccaagttgtggactctaccgtagcccatgcgccgaattcaccattattatgtccgaccagccaatagttgctatcgcgtgaagtcaatgtccagtgcacagcactaatcttctcgaatccgttccctgtccaagtagtcgagtcaccgaaaccttggttttcgatattggtaacagcccctcccatactgagtactaaatacatctcacgctgagtaggtagacgccagccactccctttgctttcgcatgccgcttttgcttccgcccaagttttaccattactactggaattttcaatctgaaacttaggagcaaccttattcattgcgccacttgtatccggagtttcacctgaagcaaataacaccgaaggatctgttcctccactggcatcgcgagagacaatagtgacccccgaggattctaccatcaaataagggtacttctttccgctatttgtattatcccttacgcaacgaaaataattattattactaacaggtgcggaatccggataacctgccgacatttccatcccaaaacgtgttgtagagcctttagcctcatagtatgatgaagaccagtagttacctgtccagttttgataccacccatatatattctgaccgtcatgataattactgttaatcgcattaccacccaaagcattttcatagacaaatgacagcaacagttcactagcagtaggcagacgccaaccatcgcctatattcctacagatatcctccgcatcggctacattttccaatcgccccacactttggttagttccgttataatatctcctattatcaaaccgaagcggataaagatagaaaagaggttccccggcagttgtgtaagatttggtttcggacaccatctgaaggtcaatcgtacgataaaacgggaattcttcatccgccacggtatgcattacatttctgaacgtgattcttatcgttccgctttttccttctttccacttgccggggtgaagcttcagcctgaaatcgtatccatgaccaaccacatcatttcccttgccgtcatcatagcctatgatagactcaagatacatcttgtcgtccgcattctttctacctataattacatcattatccgaatcggtccgaatcagtccggtgccatcatcgttcgttatattcaattcctcaatatccataatttcccaattgttattgacaaacaattgcaagtattgttccgcacccagattgactttataagtacgactattgactgtagtggaaagatatcggagtgaaaactccagctccccctgattgatggggaattgtacttgagtaaggtatccttccttatcgtacaggtcgaacaacataaagtcccaacgccaccaccagcctgcaccatcttcaacagtaccatcgcctgctcttcgcggattaggctgtatggtaaacgcctgtactctttcactgaacggtatcgcattcgtcctgtctaattgcggaatcaaaccgccggcattatattggaccatattgacaccgccagtgccataaagcttaccttctatcctatccacagaaaacatgacatacaccgtctgcggttcgagagggagttcgtcgccatcaggatttcgaattggaaaaaaaagacctctctccaacacatttccgtatgcatcgacaaatttgataattcccggatctattgtatactgtgtcacttcaatattgtgagtcaggcgccctgccgtcaacgtaacagtagccttacgcccaacgccaatattttcattattaaaatatggaattttcaatttgagttgggtatcatcgttcgcaacgcccgatgccgcatcagctccaccttcaaatttgagccagtcgctccctgcagtaacggtggccttccagccgccgggactgtcagtaaaaacgtctatggcataactattattctggtattgagttacagcgacctccgattcacccactccgagcatatattgcccattgtagactacatctttgactttgtcacggtcatagtgtatcaaccggattttaaggttggacatgactgtataagatgccaacgcctcgctaaaacttttataaccggtacccaacgccttagtaatggtaatgatgtatttatggtttcgcttcaagggcaaatattccacctgctctcctgtatttccgtttttggtaaaatccacccggtaaaatgtcgattcacccgtaccgatctttcctttcacaatcaggcaagtagcatctttacggctcgcttctccgtcttgtcccgcaccaccggcatcccctgccgccagggactcaaatgtataaatctccccatcgtagggtgtgttaccatttacggaataaaggattgcattcccttcctccgtcattttaccactgcccgtggggagaacaggagtatccggagccggttcagtaacctgtccgtttgtgttccatgccggagcaatgtatccggtggtattataattggccaggtaaacctcttcgaccgtgaaatttgaagtgacactgttattacggatatcgatacgcgctagcatacgtttcatattaatgtcggttatcggattcatcgaaggagtgattttgcttattaccttctccccgtacatcggaatccgcgtatacccaccggttgtcgagccgtctgccagccatttgccggtttgggtgtgaagcatctcttccattgcccgaaccttggtggtcactcccttcgtgaagcccgacacaataccatcaagttccttatttgctacgaccacgatgcaggtagatgcggtagtgggagaaagtacggcagagaaactcacagtggaattgtcagccaaatcctgcgtaacttctgtagcgctggcccattccagaaatactgccggcgtttttgacatatcaaaaacaagaatatccaccgtttctatttcgtcttctttctttgctgttcccgttccggtcatcgtacgcgaagatacggacgggaggtttacatcgggaaccgttaatgtaaagcgaataccgtttcctgccggagaaggcgtcgactcaaattcttcctgtacgcatccggtaagccataccgtcatcaacagaacagacaaaagatagcactttctttttattgaaaacccatattgcatatttctatttcctttccttaaactttgatattgcatattcgtcattatggtgcggtcaatgtcaccgttattggcagattatcaccattcgtattggttagtgtgagtctagccgtatcaccggacacagcatcggctctaaagtagaagtaaaccgcatcaccactcacgccacttgtttcgagcattgtctcactgttaagcagaattttatccggatcctgtatctgggttatcttccactcccatattcccggattacccgaagtaaaaacaatcttgcgacgtcgcatatttccggttccattatcgttgctgtccaactctacgtttgaggtcagccactctccgtcttctctccactggctcaacagtacatggtgctgcagattaccagcattgatataaaagcctgtttcccgcttagttccggttcctgaattaaatttgggcatcacaacctggatattatacgtatacactccttccgaaagagatatctgagtcatattaactgtcggccacgtatccatggtacttttgtttaatgacgcccccggcagaaatcctgtatccggactagcatcataattcgttttcacttctatattgacagtgaccccatcaccagccgtctgtaccttggtctgcgataatttgagataatactgtttatcgaaaattacattcaccgggctttccgtccattcaagcggggtagctgaaagctgataggtttcgttggatatcgtaagattgtagttgatgtactcgcccgattcccaagaatgcggattcttggcgagaatatcactgaacaggaattcccgaccgccaaagttggtggtaacaacaattttggcggttgcggagaaagcgtcagtcggcaacatgaggaatgtatcacctatcaaggtggcatcttcggtcaccgttttgttaccgatgggagtagaagcgaccttcccggtgacgacatcgctccagacaaacttcggtttgccgtttttcgtcgtggtggtcggaatttcagtcatcgcaaggttaccgctttttcctacattctggaattctattttctcgatagtcacctcattcggtacaggagctactttcttgaatgtaaaggtaaccttggtcaatgtgtggtagaagtgtatattcacaccttcaacccatacagggcccgatatagccgccaatacatcgacatgattggcggcagattcattcgctgtataattcagcaccatttctccgggatcaatgaaactcgcagtaggcgcattcgcatcactgtacggataccaggagaagaacttcatgctcgcattcaacaatcctggccaatattgcaacggcgagatggtggctgtcaggtcggcgttaaccgtagcacttgcattgaagtatggttggggaacagaagcattgggagtcagtgagccgtaaagaccgaaagtctcttctttcagatcggtattcgaagagattaccgtaccacgagtgtagacatagccaccttcaccgatacgttgcacaacaattaattccttatcacacgtcatctcttctctgacacacgaaaagaggacaaccgaaaggacagccattgccataatcatcctaatattatttatagtctttatcatcttacttcttttccgaaattaaaaacaatcagcgaaagatattacaagtccatatccaaatcaatgtcttgtctttcaccccaatcttctacgcttatcgtcagtatctgaatacctatttttcctacgcgtgccgttacctgatacacgttgttccgacggatctccgtaaaaggttgcgctgtcggactacctgtgccgtcaacctttgttacgctttcaattactttcccggttattccggtgacgtccgaaggcccttttaggacattagccatactgatagacagtcggtcggaataatccgacttgaataggcgttcggctgtgtagaacgagcaaagcaacttccggttttcagctccgggagccgatgagtatgcccaagtttctgtagtcgcagccgtccagctatgcgttaataaattgctttccgacacgtcttccttcacctttccgtagttttttgaagagtcggcgttatcacgcgtgccgttgcccacatttcccatcacgaaatagctatcgtgggaaaaattatgcaaggtgacactggtgcttccggcagtatatccggtcactgccccgccgtctatagcttcgataaagacatctacccgggctacggcacgttcgattaccatttgcactgttttggtttcatcgggtgctatggatatatcccggatcactcctgtcataggcattccggtcgccgaaataatctgcccgtcactattcagtatgctggagatgtcgtaaatcatctcttgcaacgtcaaaagattagctataccgtcaagttggcttgtgagactctgcggttcgttggcaataactacgaccaggatatcattgctggaagtcacttcgagaagttgcgcatctatatcagtagctgtctccggagtgctcaacaggatgtgttcattcacatccagcctcacgccaccgggcgtgctgccgaatacgataaaccgcatggagtttatcttctcctgttgttccacatccccattgttcaccaagtcgatgctaagttgcgcccgggtagtatgggcaggcaactcataagccacatcagcttctctactacatgagaacaaaaggatggtggatgccagataaatgatatgtaatagcttttttctcattcttaaacttccatcccgtggagccaatgaatccaggtccccacgacaataccaatttgaaggaatcctcctccgtttttttcaacaactgtaaataccaggttccattcactctgcctgtcaagatactcctgaaagggaagttccgttccgtcgtaacgggaaaccggccgggcaatgctcaatagtgtcatcagattgtagctccagacttcggcttcggtattcgcatcccttataataaacttataatcccatccgctcctgttgagcaaacgcatcgtattcaggcgtgcggacataaccacatcggatatttcacccggacctgtatagtaaggcacataagtaattggcccttgtcctgtgggttcgttttcccaggaataaaccgcattttccggtgcctgaatttcaaatgtatattgtgtgccatccactttattttcctcatatcccattaacgcgagattaaaccgattggtgtcacgtatcaggttcaccggataaattttgtggttggtattggatggcaggtggtccacttccacaacttctccgaagtaaagatgctgaaattcgaaattaacaccccccgtctcccgcttcagggatacaatgacttgttggagggtggttgttcccggcaccagtttattacctgcattgtccgaaagccggaatctgtcagacagacttccgacggtcagtactttataacttccgaaatcgagctcgtcggtcaacgacattcggtttccaccaaccagcgcagcaaccttgacacttttggtgaaaagcaatttatcatcgctatcgaacacaagtacatccaccgatttaacctgcggattaaatgcatccgcatattccatattgtagtcgaatacaaattccaaccaaagctcgcaccgtggcaggtcttcgcgtatactgtcgcacgaagccatacatagcatcgaagcaacgataaggaacagcgatttagtttttccgaacatatcttttcttttagggggcaaccctatcggtttgccattttatattgtcagagatctctattttgtgacctccggttatttcctctttttggggcgcgctttgcatttcattgcatctcggatgcgccggtatatttcagtgctgtttttgggaagcctgtcaccggcttgtttttacttttttcggcggtctgttccgtacggaatatctattttaaaagtacagggcaggcagtccgcactgccctgttttctttgaaagtaaagaatttatttagatttcgaaatttgtagtccagtatatccacggagcaactttaatctcaaaatggagataggcacctttcttatcgatatcttcttcttcatccggatcttcgggaccaccaccaggataccacggtgtaccgttaccattcacctttgtcagcgtaagcgtataatagttattacgtactacaccgtatttcccatactccatgtaagaattggctgcattgtcatgacgaatctcatagtagtaatagttgagactctttggataccaatagatgcaaccttcttttttacacagttcaccaccattctgaatgttgttgtcgtcaagaatagcctgcgtaagggatgcaaaatcacccggatcattggcggtaagttcagattttatctgagtatagaacagttcgcatgccgaaactaaaagtttctcctgggcggtcatagggtctgaggctgtttctttagctttggcaggcgtataagcagccagcaagtcggcaaaactcttgaagtttacagagttagttccgttaggaagacgataccagtcatttcctaaagtaaattcaccagacttccaaggtgcatactgtcccttaagtaccagacgcgtagccgcaccgaacttctgatatcctgcggccatcgtattctcgatacagtatttgtaattatcacctgcagtcgcactttcagcaacccattccaccttaggttcgcgagttgcagcatcgagtgtattcttaataatgcctgtaagatattcggttccacccgcagtcgtaaagttcgggtcgactgtatagaagttacttttgtaaaatccggtagtatgagacgatgctgtggtagtcttctttgcaaaaggaaagaacagggagttgtagtaatctatagtccaatttccaaaatcaaactgtcctagacttgcatttgttccatcttcaaaaggtccaactgctaatggactgccaatcataacctccaattttgcagcaaggcgttctatctcaagggtagccggattacttttcgctgcattctgagcttgcgcttccgatttatagtcgctgaccaaaacaatcttatccgatacatcaagcagacattcatcctcccatgcatgattggatggatctgaatcggaatcatcgtagaatccgacattaatcattgcacaaccattggagtgtacaacctcctctaccagataagcattgttgggcttagtattgttttcaggaactgtaatcattccattgatggtagcataggttgcacccgctgaaagattatccaagcgatcctttaattggtaacctggattggcaataacaagcaaatacttagtattcggatccactttaaccggagtattcggagtcgtaactccactatttgttccgaaagaacttgatcccaataccgtggcatacttagttgccttttcatccttagtcaccaccttactcgcattgaacgtaatcaaatagagctcattaatcgcactttcctcctctaaagccgtctgttcaccagaagcacgtgaaccaggcactttgggattagtcagactaattgatacgtaagctacatcataacctgctcccccttcaacctccggattttcctccagattctcatttgaacaacttgccagtgccgcaacaaccagcaacgaaactaaaattgatttaatctttagcataatacaaaaaaatattagaattaatacttatataatttcccacttaatcagtaagttttacttaccattctttttcattttagcagcattagccttcttcctgactaattcttccagattgcccctagctgcatccagacctgactgctctgcaaacttcaaatacttcttcgatgattcataatctcccttcattaacattaatattcccatagcattattatattccggcaaattcttattcgaattcaccatgcccagataacgttcagccgaaaccaattcattgcgtgataaagcggcagtagcagcatttatatttgcaatctcactctgcggatacatccggacagccgtttcgaacacatcaataaattcttgcgagcctgtcggataggtattagctaccagaaacatttcattcaagctcaaattctgcggacgcgtcttgataatctcttttgcttcctccacactaaaatccctcacttcgtaattcactttgcagatagccacacgcaaacttgggaaaatatacttcaacaagtatcggtaaggcgtccctccgtgaagttgcatcagttttgtttctcttcctttttcaataggtatgttcctgataatatccagcacttcgtctttatattccaattcgattgtttcaagcgccttctccagtccgtcccagttttcacctccaaagacaatgtagtattggtttctcggaaaatcgtatctgtatgccagataatcccggagcgccatggcacgtccttcagacagacgtttgttcgctgccaatgttccttccggagacgcataaccgataatatccagacggttcactttcacattcggatcggacttcagctcatcgatcatcttccggattttagccagctcctgagggttattcatgtattcgggacgaatattgactttattcacctcgaaatccagaaaacattccgcttgaacatcccgttgtttgatttcttccgctttcggttgcagataggcaaactgaggagccactacgtaaggcgtccatacacgttccaacgtcactttgccaaattcctcgatgttcattaatgccgtttcaccgcaaccacattcgtcacgctgcacgtccagacgcgcatccttcatccatgattcgaacggaaccagatattgataccgaatcgtatcatttcttagttttccggctttttccactatatacggcttctcgtagcttctcttctccttggcgctcatcaacgcaagcccacgctcatacgccaaatactcgtcacgacctttaatagaaactttcggaagattcagagtgcgtccggaagtcaccagccgcggaattaaatccattccccgggcagatttcactttcacattattcaaaacaaaatctatatcgacatgaataaaatcacctttctgttccaaccgcaccggattcacggtaatgccaccttcgtaagagcgggattgagccatagctgtgtttatattcaggctgcaaaccaccaacatacacacaaggaaacctatatttcttattatcatactccttattatttaattacataaataagtgacacacttgctttggtaggtccgaaataatttttgctgctttccttcaatctcgtaccacaggtagcgcaaggatacttgtcatatacaatgtgcgcatatcccactccgacagacgtttctatactccagcgttttttcagaatccacgaatatcctacggaaaagccaccgccataaagatatccctgataacgcgtatgctgcatattgtcactgataaaagaccagtcgggccaccctcctacattgaaatcggcataatgtccgtgcattccgataaacatacggcgaaaactctcacaaaaccagtaacgaacttcgggttgtatcccccaatgacggaggcgtttgccgtcggaaagtttccacggattataattgaccggaatgtccagcgtccatttacgcaccagtccgatctccaaccccaaattcatggtagtggtagcgtcatacagcagattgcttttcaacgcaaccttctgggcataaccctcggaaatagcacatccgagcatgaataatatgagtatagcaactttcttcatttatatcacatttactgttatttattgccccaattgagtaacatctatttttatgcgttgcacattactgatgcccgttttaacggaagacgccattgttgtgagatgtacgattccgtttctggaatccgcctctatattgggcaataccttaatatatatcttaccgtcttcaacgataatgcgttcttctcctgtatgttcctccggcattacggaagaatacagacggatccaatttttagcactttcatccacttcgcccgtaaggcagaaataattgatttcatatacctccgaatttgaattttcagtaggcatgagctgaagcgtacttcccgcagcaggaacagctttcctttgtctaatatgaacttctttttccaaatttcctgtttttaatgttagatatacatcatcctgtcacctgtttctctttgtccttcttcataccacatcaaccagtcagagtcccccactgttacctatggttacctatgttatcactagaccaacggaagtgactatcggtatcttgtaataagagtcttgacttttgtaagtcccttgaatgttcagacaggtgttgttctgaagccggactcatacataatataattcatgggaatagtttcttgaatgtcactataaggcagagagccaagcaatggattgctcaatggtttaatcaacaacccggcatatatatccgcacaagttgtcacctctggcgttaattggatgagagtgccggtcacattcaactcctgcacacaccccaccacagataataaagaaatcaaatataaaaaacaggttgtaagtcttgttatttctctcattaattctctaatgtactttcttctacttctcatatatctctcttacttctctttttgcttttctctcaggacaatattttttgtccaaatctcatattgcaaatttcggaatattaaaggagatacaaaattgtattcatttctgttacagagaatcaacttagaataaagggactaattatgtaggtagcgaacaacaaggttacgaaattcacaacaaaaatactcaatatcctcatttctttcgatatgcgaacattttaaaattcccaagtttctttcataaaaacttggacaatagagggaagttatagtttttcgtgtcatttagacacaacttaggcacaaattagacagaataactagctgttttatacaacaaaataagctaataacttgtataatttgtgcccaaatgacaaaatgctcaatttctgtatatatataactatcagattataaggttttacgctcagtttccgtaggtgccacctcatcaggaatactgaattcgcgattagcaaacagatcagcaagtcctgaaatttgtttcaggcgcaacaattcatcacgatccataccaatatttttcattatccattgatcggacatacctgccttatcaagctccgcaacaatgttgcacatcaattcaatgttatgcattccacgcgcacggttgtgccggattgttgaactcatacggttagacaagtctttgtctatcaccacaatcggcaacaaaccgttttcacgcttatagattcgttgggaagttttcaataccgtatagcgatggtaaccatccaccaggatataacggtcttcatctttattgtagtaacatacacatggcatcgtaaagccatcttcccaaatagaaagttccagcaacttcatttcaggcggtgcaacgacattcggattataatcgttcgcatatactttttctacgggtaccgcttttacctcgtaaacagggcttttatctacactcatgatactatgattctatattgttccataatttgacttctcttactcatctcctcctttgtaggtgagaatcccatatatttgcaggcatggtcattcttaagaatacaaacgcacattcgcttatacgtgggtatttctttgaattccggaatgtcaatatcatcctgatattccatacgtaccggttttttcaacgttttgtagttactgttgtccataacgataatcggtactttcgcatcaatcagcttctggatggtggcatcactcaggcatccgccttttgtccgccagaaattcacgctcactgaaagtttccgtagataattcttcctcgcccgctccggcagagtagacaacaaaaaatacataaactcgcgccatgtatatccttcgggaagtttcaccgattgccatcccattgcatgagtaccaccatacataccggtaaagttcacaccgttcacccttcccaccattttaccccaggtattaggatcaagcacccggtaaagctgcaagctctcttgtgcctcattaataaagggacttgctacacgctgacgctccagattgactccggcacgataataaagatcgtataaaacattataatcccactggaattttccattggcagtccatacatccgttgttttccagtcataaatagggtaggcattataaatatcattccctacttttgaagtccatttatatttatgatacatctggaatttacggctcatatagatacatctccaccgattgaaactttcctgtgtacgaatcccgatcagacaacaagtgcgcactgcatcttttttattatgtatccattgcgcaaaacgcatctgaaattcataatcccacatggttgtattataaaaaggaaaatcttctttggtcattgcctttttcggcatggaacgaacccatatattctttttgctgtcttcccacggacgccaaaaagattgatacatcgaggtgcaggtagccacacggaaagggatgcatacccggtatacatccaaaatatccttattggcctccagcatccggtctacatagtcgatggtcattttatactggatctcataatccatgtgaaaaactcccaaacgtaccttcaggttattcttccggatataatcgatacacatattcagcagtaccccgctgtctttacctccggagaatgacacatatatattatcaaattcattaaatataactttcagtcgttcttgtgctaattcatatacattctttgtgcctgctattttctttttcgtcataagttatctatacatttttacataccgtgtccatttcttgtccatcgatacaaattcaaacttttcaaatgttcctttatcttgtaccagtgtgaccgaattgagcaaccaactctcgggcctaaattccgcaacgatagcgggcaacagatgtgacaggatttcctcccgtacggtgccttctgccttcacataataattattgattacagctttcttccggcttttctgttccacggggacgaagcccaccacttctttatcttcaatcgcaatgaaccacacatactcttcgcccgtcttgaaagggtaattattgtttgcgcgtatcacttcgggatccatcaccatcggcgctaaaagccgatataagtgtttgtcttttccttttaatcgtattatctgtatcatatcattcaaaaatggacacacaaaaataaggaaaaaatatcaaattcgtcatttctgttcctaaaacatttgtttttcacactattatctctatatttcgatatttttgaaatcacccatacgccattcctctttcacgtttaaagtaagtcagtatagttgcaaagcttaaatattcccgtccaggagtatgcaaccgacttttaaactgatagtaggcaaagatgacttcgcatgccaatttatatttgaaatgcagctttaaacggtgctgcaaaaactcaaacacccggcagagatatgcaaacacctcctccaccctagcatttggaatcactcgtggcgcacgatttacatccgctatatgctccatctcattaagcacatattccagttgctcaatttcctcaccggtgttttgcattgtacacttcatttgttctattttctctccctgatggatgtactgttttcgctttcgttgtaaacgatcttttattatttctattcctttcaacattataaaatttagttatatataaatggtttgatattactgattattaatcgacaaaaccgtcatataaaatttaatatcaaatgcaaatatagaaaagattgtttaaataattagatttttatttaaaaatattcatacttattttacatttaaattaccagcatcagaaaaacgtttttttcatccaatgaaacgagtcataattttgcggcgtactaaaatattttaaacaatggataatcaatcttttgactggctgcttcacggttgccacgtactatccgagatggcagtggcttattttcccaactatcaggataactgatatagacgatacgctggcaaatgcccataccctcctcgaccgattggaaaatgaatgtggtactgccgaacatctccgttccacgtcacaactcatagaggacactataagttgatagaggcccgcatggccagcaacaagaacagtgctacaggactgactactggatttgccgaccttgaccgggtgacatgcggctggcaacccggtgaggagatcgttattgctgcccgtcctgcggtaggtaaaacagcatttgcactgcatctggcacgtactgcagcttctgccggttatcatatcgctgtgtatattttcacatatacaatatttttcttgatgaataactgactattaccatacattaccgatggcagtatggatttagaagaacacacatttgcaagtcatcaagaaaatcttgaacctgcaagacaagaaaggaagcgaaaatatgatttgcataaaatttaaatagtctctaaccaataagtcatctttatacaatgacgagttgtttgacaaacttcgtagttagcaataccggagcaacattcacaattacttatgaatcaattatttacagcaactctttcatttaaacaaaaattgcctgctaaaaatttagacaaaatttggtcaaatattcctttttattaattaaaaaggctacagtttcacaaactactattggaattcggtctcttttccatatatttgcgcccgcatttttgattttcgaatgaacctccttattcaatttaccaaaactagataaaacgaatggaaaaaataaacgcagtaattacaggagtcggaggatatgtacccgattacatcttgaccaatgatgagatttccaaaatggtagatactaccgacgaatggattatggggcgtattggtattaaggaaagacgtattttgaaagaggaaggactgggaacttcttacatagctcgtaaagctgtcaaacagttaataaaacgcacccgaacaaatccggatgatattgatctgataattgtagctacaacaacccctgactaccgctttccttccacggcttctattttatgtgaaagactgggactgaaaagagcttttgcttttgacatgcaagctgtttgcagcggttttttatatgcactggagactggagccaattttatccgttctggaaattacaagaaagtggtagttgtaggcgctgaaaagatgtcgtcaataataaattatgccgaccgggcaacttgtccgattttcggtgatggcggagcagctgtcatgcttgaacctactactgaagattttggcattatggatgctgtgttaagaacagatggtaaaggattgccttttttgcacattaaagcgggtggctctatatgtactccttcttattatacattggataatcaaatgcattatatctatcaggaaggacgtactgtattcaaatatgcagtatccaacatggctgatgcctgtgaatctatcattgcaagaaaccatctaagcaaagaaaacatcgactgggtaattcctcatcaggctaatcaacgtattatcaccgccgtaacacaacgtttggaagttcctgtcgaaaaggtcatggtcaacatcgaacgatacagtaacactagtgccggcactctcccactctgcctctgggattttgaagataaattcaaaaaaggagataacctaattcttactgcatttggagcaggatttgcatggggagccatctatgtgaaatggggatatgatggaaaaaagagatagcgattattcgctatcttcaaaataaaaaatcctctgatttactgaaaatcagaggattttttatttcctaatgcggtgcgtacgggactcgaacccgtgaccccatgcgtgacaggcatgtattctaaccaactgaactaacgcaccaaaatattcactttagcatctctctcgattgcggatgcaaaggtagatatttttttgaaacctgcaatagcttcagtatcttttttctgaaaaagtgggtttattaagaattatcgtgtacatttgcagctactaataaaatagaaaatagaatgaaaaatacaccaattgaacgacatctgattgacgaaaccatcaatgagtttcaaattgtcgatttttccaaagctaccattcgtgaagtgaaagccattgcttcaaaagcagaaacagcatcgggagttgaatttatcaaaatggaaatgggtgttccgggacttcctccttccgctgtaggcgtgaaagcggaaattgaagcattacaaaatggcattgccagtctatatcccgacatcaacggattgccggaactaaagaaagaggcatccaactttatcaaagcattcatcaacgtagatttaagtccggaaggttgtgtgcctgtcactggttccatgcaaggtacattcgcttcatttcttacttgcagccaatgtgacgaaaagaaagatacgattttgtttatcgatccagggtttccggtacagaaacagcagttggttgtaatggggcaaaagtttgaaacatttgatgtgtatgactaccgcggagaaaaactgaaagagaaactggaaagctatctgaaaaaaggaaatatatcagccatcatttattcaaatcccaataatcccagctggatttgcctgaaagaagaagaattgaggattatcggtgaattggcaacactgtatgatgtgattgttctggaggatttggcttattttgccatggacttccgccaagatttaagtaaaccgtatcaacctcctttccagccatcagttgcccattatacggacaattacgtattgctgatttccggctcaaaagcattcagctacgccgggcaacgtattggggtaagttgtatctctgataaactataccaccgaagctatccgggactgaccaaacgatatggtggcggaactttcggaacggttttcattcaccgtgtgctttatgcgctttcttcaggaactagtcattctgcacagttcgccatggccgccatgctgaaagctgccaacgaaggacaatataatttccttaacgaagtgaagatatacggtgaaagagcacggaaattaaaagaaatcttcctccgtcacggttttcatctggtatatgacaacgatctgggcgagccgattgcagacggattttatttcaccatcggttatccgggaatgaccagtggcgaactggcgaaagaattgatgtactacggagtcagcgctatctcattagtaactacaggaagccatcaggaaggattgcgcgcgtgtacctctttcattaaagaccaccaatatgctcaactggatgaaagaatgaaactatttgctgaaaatcatccgatagcctgattatttgacataagatattcataaaagccattcttaaaatgaaaaaaaacggaaagaacgattgttattccgttttttttcttactttagtggcatgaatatcgactctgacatatttaagattcaatcgaataatgtgttgccatcgagaggaaggattttaatatcagaaccttttctacgtgacgcaacgtttggcagatccgtaattttactggtcgatcatacggatgaaggaagtatgggattggttatcaacaagcaactgccattgttccttaacgatatcatcatggaatttaaatatctggatgagattcctctatacaaaggtggacctattgccactgataccctattttatctccacacattatctgatatccccggatccatttctatcagtaaagggctttatctgaatggagattttgatgaaataaagaaatatatattacaagggaataaaatcagtgaatgcattcgtttcttcttgggatattccggttgggatagcgaacagttaaataacgaaatcagagaaaacacatggttggtgtctgaagaagaaaaatcatatctgatgaaaaacaatatcaaagatatgtggcggactgctttagagaaactaggcagcaagtacgaaacgtggtcacgcttcccacaagtgcctactctcaactaatattttatttcttaggattcaaacattggaggagcaatgcatctttgtagcagccctccacttgcagccagtttttcaataatccgcattgaacgaagccacaagacgtgaacagctttacacaaacgtcattatctgtcgtgacatgtgcataaagctgacttaaagacagaaaatcaaaagcatattcacaaagcagcttcaatgcgtcggtggcataaccttgctgccgataatccttatgcacggcaattcctacttctccccgcgaatgaaggggaacgaaatccgtaatatcaatcgtaccaagtatacactggtcggatttgcgcacaatcatcagacgtaattgcttatccgcaaacacatcacactgcgaaccttcaatatattggcgcaacacgtaacgggagtatggaaccgtaaagttactgatgtcccacatcgaaggatcattttccatctcatacattatatccatatcttccggttctaccgcacgaagatagatacgatcgttcatcaagaaggactgtctcatagcttttcttcttttgcaatgtgaagttcgttacgcaatctcttctcgctgggcagacagaaaagtgacgctgtcaggccaatcagcatacagagattacccgtattgctcaacgtcaggtagtaacacaaaaggttcaccacaatagctacttcaagcactcccaagcgaacaatgttccattgcacatatcgcttcaaggcaagcgtgatagtcatgtgatctatctttttcttaagcaccaagctaaataatttgagagaaagaggcacacacaaagcagtgagcaaaatgccgaccgtctcaaaatagtagatagccggtgcgttatctaccaaacctcctacgggatagagttcaaactctcctgccccaagcaaaaatgccgggagcacccaaaagaaaacataactgatattcaaatttctgacagctcgttttatctgttcttccatgttcgttcttaaataattaataatgattatacagttccggtaaaaagcgtccggttcacaatgctgcgtcctaaagtcacttcatcggcatattcaagttcatcaccaatcgatatgccacgggctatcacacttagtttaacccctagtttatccagcttgcgatagatatagaagttggtagtatccccctccatcgtagtgctcaatgccagaataacttctttgattccaccttcagccacccgctgcaccaggctttcaatttgaaggtcactcggtccgactccgtccattggagaaataaccccacccaaaacatgataaagcccgcgatactgctgggttgcctctaccgccattacatcacggatattttccaccacacagacagtggaagcatcccgttgcggattagcacaaatctggcaagtttcagtatcggatatattatgacacactttgcagtatttcacctcacgtttcaacgttatgatagaatttccgaaagcttccacagtagccgtatcctgacggagcagatgcagaacaagcctcatagccgtcttacgcccgatacccggaagtttggaaaattcgccgactgccttttcaagcagtatagaaggatattgttggttcatagataatatttgctgttctatcgataaaaccctgcaaagatacagattattgtttttaatacctacaaaaattgctacctttgcatctgttatgatgatactagtcactattctttgctacttcgcggtattattactaatagcccgtatcaccggacgtaagggcggatcgaatgcagcgttcttcaagggagaaaaccaatcaccttggtatatagtctcttttggaatgattggcgcctctatctccggagtcactttcgtctctgtaccgggaatggtgcgcggaatggatatgacgtatatgcaaacggtactcggatttttcttcggatacatggccgtagcccatatcttacttcctttatattataaattgaatctgacaagtatctacggatatctcggcacccgcatcggggtgcgtgcctatcgcaccggttcctttttctttctgctgtcacgcatgttgggaaccgcagccaaactttatctggtatgcctcattctccatacgtatgtatttcaggaaatgcacgttcccttttggctgattgctgtcggttcggttgcattggtatggatatatactcataaaagcggaataaagaccatcgtgtggacagataccttacaaacattttgcctgattgccgctctgatttttatcatctattttacgatccaaagattagaccttaacttcagcggcattgtgcaaacaatccaaaacagcgaacacagccgtatttttgtatttgacgactgggtatcccggcaaaacttcttcaaacagttcttcagtggtatcttcattgtcatcgtaatgaccggactggatcaggatatgatgcaaaagaatctttcttgccggaacctccgggaagcacaaaaaaacatgtactgctacggtttctcattcattccgctaaatttcctttttctatgcttgggaattctattgatagcgctagcgggacaaatgcaactcgaactgccagccatgaatgatgatatactgcccatgtttgcagcccaaggttatctgggacaatccgtattggtactttttacaatcggtattatcgcagcagctttcagcaactcggattccgccctgacagccatgacaaccagtgtatgcgtagatctgctaaatacggaaaaagacacagaagaaacggcacgtcgcaaaagagacaaagtgcatttatcgttatcagtcttattggcattcttcatctgcctggtagaaatacttaataataagagcgttattgacgccatatatatcatcgcctcctacacatacggccccctgctcggaatgtttgctttcggactttttacacgcaggcaaacgaacgaccggtgggttcctctcatagccatcctttcaccactgttctgctatcttgccaactggtggattggaaaagaaaccggatataaattcggttatgaattgctaatgttaaatggaacgcttacctttgcagggttaatgtgtatgtccaaaaaagagaaaacgctgaaagtgccataaaaacaggtactccagagtttataataaataatggcagagtttattataaactgcgcaatagtttattataaacgatgagcgagtttattataaacgattttataaagaaataaatgacaagaaaatggaaataacaagtgctgaatttgtgattagcaatacggacgtgaagaaatgcccggccggtattttcccggaatatgcctttataggccgttcgaatgtgggaaaatcaagtcttatcaatatgttgaccagccgtaaaggtctggccatgacctcttccactccgggaaaaacgatgttaatcaaccacttccttatcaataagaattggtatctcgtcgaccttccgggatatggctatgcccgacgcggacaaaaagggaaagaccagatacgcactataatcgaagattatatcttggaacgggagcaaatgaccaacctctttgtcctgatagacagccggctggaacctcaaaaaatagacctcgagtttatggaatggctgggcgagaacggtatccccttctctatcatctttaccaaagccgacaagctaaaaggtggacgtttaaaaatgaatatcaatgcctatttacgtgagttgggcaaacaatgggaagagctccctcctcacttcgtatcttcctcggaagaccgcacaggacgtattgatatactcaactacatagaaaacataaacaaggatctcaatgttaaatgaaagaagaatgaaaatgaaaaagaattttttatctattgcctttatggcagtatttatgctgatggcgactaacagccaggcgcaatcatggtccgacttatttaataaggacaacatttcaaaagtagtaaatgccatcaccggaaccaccgaatctatcgacatgaccggaacatggagctacaaaggttcggcggtagagttcgaatcggataacttactaatgaaagcaggcggagctgccgcagctactatggctgaaaataagctgaacgaacaattaagcaaaataggtattaaagacggccagatgagtttcactttcaatgccgacagtactttcaccagcacggtgggcaagaaaacattgaaaggcacttactcctacaatgcttcaaccaaacaagttgatttgaagtatttgaaacttctgaatctgcacgctaaagtaaattgcagttccagttcactggagttactgttcaactcggacaaactgttgaaactaatggctttcatcggtagcaaaagtagcagtaccgcactgaaaacagttagttcactggccgaaaattacgatggaatgatgctcggattccagctctcaaaatagcaaaagagaatcgtttaatactatttcgcactccataaagtatattttaggggaaaagcattatctttgtcgtttgtaatcaaaaagagaaggaaaaatgaaaaagatactttttttaatgaccctgttagtaatgggcgtaagctttgcatttgcgcaaacaaatgcagatatcaagtttgacaaaacaactcacgatttcggtaagttttctgaaaacagcccggttgtcagttgcacatttacctttactaatatcggcgatgcccctctggtgatccatcaggctgtagcctcttgcggatgtacagtacccgaatatacaaaggagcccatcatgccgggtaaaaaaggaacaatcaaggtgacttataacggaacaggcaaatatccgggacatttcaaaaaatcaatcaccttgcgtaccaacgccaaaacagagatggtaagattgtatatcgaaggcgatatgacagcaaaagatgcaaagtaggaaaaaatagactattacataaaggagaatctttcggttctcctttttttttgtttactttgaggacggaaatgtaaattaacacattagcaaattataaaaactatgaaacaagaagaagacaaattcaccgggttacccgagaatgcgttcagagagttgaaacctggggaagtgtacaacccgttgatgggtccctctaaaaattatccggaagttaatatctggtcagtagcatggggtattgccatggcaatccttttttcggccgccgcagcctatctggggttgaaggtcggacaggtatttgaagcagctattccaattgcgatcattgccgtaggagtttccggagctgccaaaagaaaaaatgcgttgggagaaaacgtgattatccagtctatcggagcttgttccggagtaatcgttgccggagcgatcttcaccctccccgctctttatattctccaagctaaatatcccgagatgacggttaccttcatgcaggtattcatcagctctttattgggtggcgtattgggtattctattcctgattcctttccgtaaatacttcgtcagcgacatgcatggaaaatatcctttcccggaagcaacagccactacacaagtgttgatctccggcgaaaaaggcggcagtcaggccaaaccgttattgatggcaggtatgatcggcggattatatgacttcatcgtggcgacattcggatggtggaacgagaattttaccacccgtgtttgcagtgccggagaaatgctggcagaaaaggcaaaattggtattcaaggtaaacaccggtgccgccgtgcttggtttgggatatatcgtcggactgaaatatgcttccatcatttgtgccggttcattggctgtgtggtggattatcattccgggaatgtctgctatctggggtgacagtgtactgaatgcatggaatccggaaatcacctctaccgtaggtatgatgagtccggaagaaatattcaaatattatgccaagagcatcggtatcggcggtatcgctatggcgggtgtgatcggtattatccgttcctggagcatcatcaagagcgctgtcggactggcagccaaagagatgggcggtaaagggaatgtagagaagagcattatccgtacccaacgggatctttccatgaagattatcgccatcggttccatcatcacactgatcttaatcgtattattcttctaccttgatgtcatgcaagggaatctgttgcatacattggtagccattgttctggttgccggcatctctttcctgttcaccacagtagcagctaatgccattgcgattgttggtactaatccggtttcgggaatgacattgatgacactgatattggcttccgtagtgatggtagctgtcggactgaaaggtccttcgggcatggttgccgcattggtaatgggtggcgtagtatgtaccgcgctgtcgatggcaggaggttttatcaccgacttgaagattggttactggctcggaagtacgcctgccaaacaggaaacatggaagttcttgggaacaatcgtatcggctgcaacagtaggcggtgtaatgattatcctgaataagacatacggatttacaagtggcgcactggctgctccacaagcaaatgcgatggcggccgttatcgaaccactgatgagtggtgtaggtgcaccctggttgttatatggtattggggctgtcttagctattattctgactctttgtaaaattcctgcattagctttcgcattgggtatgtttattccattggaactgaatgtgccgctggtagtgggtggagcagtgaattggtttgttacaacacgtagcaaagatgcatctctgaatacggaaagaggtgaaaaaggaaccttactggcatccggtttcattgccggaggtgcattgatgggagtaatcagtgccgcgatgcgctttggtggaatcaatctggttaatgaggcatggttgaacaatacttggtcagaagtgttggcattaggagcgtatgccttactgattctttactttataaaggcttcaatgaaagttaaataaatcattatgaggagactattatccattatagtatcacttgtaactgccatatcatttgcgcagcagcccgtcgagctacctttgtggcccgacggtgctcccaactccagtggactaaccggagaagagcaggaaacgcgccctcattttgtcacgaatgtcacgcatcccaccctgacggtctaccatccggaaaagccgaatggaatggctattatcatgtgtcccggaggcggttatcgtggactgggtatggatggagaggggtatgatatggccccctggttctgcggacaaggtattacctatatggtattaaaataccggatgccgaacggacattgggaagtccccgtatcagacgccgaacaagccattcgcatggtacgtcaacatgccaaagaatggaatgtcgatccttacaaggtaggattaatgggagcctctgcgggagggcatttaactgctacactcgctactcattataattcggaaacacgtccggactttcagatattactttatttggtggttacgatgatgcaagtcacccggggaaataccagagctgcattgcttggcaaaaatcccacaatggaacaaatacagaagttctctgccgaattgcaagtaacgcccgatactccacaagcatttatcgctcttacctccgacgacccttccgtagcaccttaccacggagtgaactattaccttgctttacaaaaaaacaaggttccggcaactctccatgtttatcctaccggaggacatggctggggatttcaggaccattttaaatataagcaacaatggacacaggaattggagaaatggttgcgcgacggcgttgtattcccggaaaaccccgaacccatgttacgaatcgggaaatcttacctgggaactaaatacgtggctaacacattagatcaaaacggagaagaatcattagtgatccggactgatgccgtagattgcctcactttcgtagaatacacgttggcacaggcactcggttcttcctttgccgacaatctgcaaaaaatacgttatcgggacggcatcatcaacggatatccttcccggttgcattatacttccgaatggatagagaatggaatccgccacggattcctcaccgatattactgccaaaaacagtgcacatacccagagaatctctctttcctatatgtctacccatcccaagcaatataaaaaattggctgattcgccggaaaatgtacgacaaatggccgaatatgaaaaagcaatctccggaaaagtcgtacattggttgccgaaaagcgaactgccggaagccggattaccctggatcatgaatggagatatcattgctatcacaacgaagatgcccggactggacattgctcatgtgggaatagcagaatataaagagggaaaactgcacctgctgcacgcttcttctacattgagaaaagtagttgtcagcgacgaacctctcaatcacatgctaaacaacaataaatcgtggacaggcatacgtgttgtccggatgtctcactctaaaaataactgattatgaaacgagtaaaacatttccttctcgcctcgtgcttattccccactttgctgggagcacaagaaatggcaagcgcctattttctggaacttactccggacgcccaatcggcaggtatggcaggtacaggattagctaccaccgacaacggtagtacagctatttttcataatgcttctaccatcgctttctcacaagaagtgatgggtgcgagttattcatacgctaagatcaaccaagattatgcgctacatagcgcctctcttttctaccggatcggaagggaaggcatacatggatttgctgtaggtttccgacatttcaaagatcctaaggtgcttgattaccgtcctcacgtatgggacttagaagctgcttatttcagaaatgtagccaagaatctgtctctttcattaacgttcagatacctgcaagccaaagccgcggaaagcgcagacagcaagaatagcgtttgtctggacttcggcgcgacctactatcgcaatatggctctattggacgaaatggcttcctggagcattggtttccaagctgccaacttaggtaaaaagctggacggacaaaagttacccgccagattaggattgggaggtacaatcgacctgccattcagcatagaaaaccgtttgcaggtggcgctcgacttcaactatctgctcccctctgaaatccgtcatctccaggctggcataggagccgaatataatttcctgaaatatggtgttgtccgtgcgggatatcatttcggagacaaagacaaaggagtaggcaactacggcactctaggctgcggaataaacttctggccgatacgtgcagacttctcatacgccttggctgataaagattgctttatgcgccgcacctggcaactgggagttggaatagttttctaagctcctcttcgaggcgttgcttcacttcgtccatcggcacatcgtgctttaattcctgacgaagagaagtgacgcctttatctataaatccgcaagggtggatataactgaaataacgtaaatcggtattcacattcagagccagtccatgcatcgtgacataatggctgcttctcactccgatagcacaaatcttacgcgcacgaggcgtatcaccttccaaccagacacctgtcgctttctccaaacgtccggcttcaatgccataagaagcacatacccgaatcaccgcttcttccaacagatgaacgtactctttcaatcctaactgaaattcttccaggtttaatatcggatagcacaccagttgtcccggaccatgataagtaatgtcccctcctcgatcaatatgataaagggtggcatcaattgctttcagttgttcatcactcaacaacatattattttctttcccgctacgtcctaatgtataaacatggggatgttcgcacatcacaatacggttttcataactctcgccctgaacttttgcccggacaatgttatcaaaccattctgtttgccgttgccatgcttcggcgtatggtatcaaattccaatcaataaaaaatgttttcataaaaacaaaggtaagaaataaaaagaaaatgcgtacatttgttggcctaatataacacacacaactatgaaaatggactttccacaggtagacttgcctaccgaagtattagcatggacgaatgtaacagaagacattctcaatatttacaagcaatcttgtcggttgcaagcatgtattgttgccatctgtaccgaaggttcgatgaaagcctccatcaatctgcttgattacgaaattcaccccaatgacttaataacattattaccgggaacaatcattcagtttcgggagagaacagaaaaagtatgcctttgctttgccggcttctctgctcattgtgccggacgaatcaatctcatgaagaatattggtaacgcatatcccaaactgatagaacagccggtagttcctcttaatgaagaagtagccagttatctgaaagactattttgctctattatcacgggccagttgcaatgagaacttcgaaatggattccgaattggtcgaattgtctcttcagactatcctgacaagcatacgactgatatatcataaatttccgggcgaaaatagcagttcgaaccgcaaaaaggaaatctgccgggaactgattcaagccatcaccgagaattataaaaatgaacgtcgtgcacagttctacgcagataaattaggtatatctcttcaacatctaagcacgaccgtgaggcaagtgacaggtaaaagtgttttggataccattgcatatatcgttatcatggatgctaaagccaaactgaaagggaccaatatgactatccaagagatagcatattctctaaacttccccagcgcctctttctttggcaagtatttcagacgatatgtaggaatgacaccattggactttagaaacagataattttcacgaaggacgatagaaaacataaatggtgagatgcaaaacaatgaacggtgaataaattgcgcattatccgcaaagtattcaccgtctattatttacagttcgctgttcataaataacagcttaccattcatcgtttacagcttacaggttcctgtcttttatggttcgtttcttattttcgtcccaaactcaaagaattgagcactacactcacgctggaaaacgccattgcggcacttgccagcatcggattcaacagcaaaccattcagcgggaacaagataccggcagcaataggaataccgatcaggttataaataaacgcccagaaaagattctgatgaatcagtttgaccgtctgctttgacaactggaaggctttaggaagcagcaataagtccgatgtcatcaaagtcaccatagccacgtccatagcaatatcagttccttttcccatggcaatactgacgtcagccaatgccagtgcctgcgaatcattgataccatcgcccaccatcgcaaccttctttccctgcatttgaagctcacgcacaaattcggccttatcgtccggtaaagcgtcggcaacaaaacgttcaattcctaaacgggaagaaacggctagtgcagtccgttgtccgtcgcccgtcagcatacagatgtcaatcccttggcgtttcagttccttcactgcttcggcagaagtagcctttatcgggtcggaaacagcaatgatagccaacaactcgttttcacgtccaaagtaaatgatgccgttaccgtccgattcatagtgaaccagcatttcagccatcacatcgcttactgtcgcactgaaatctttcaggagtttatgactgcctacccagtaagtatgtccctcatacgaggctttgattccttttcccgtaatgctttcaaagctatccaacgcggcaggttttattttttcttcgtcctgaagcgcagagacaatagcgccggcaagcggatgctccgatttcatttccgcagctaaaagtacatctttgaaatgtggttcctgcgactgcgcccataaccatccggtagctgtaggatgtccttcagtcagtgttcccgttttatccagaacaacgacatctactttgcgcatttgttccaaagccactgcatctttaatcagaatatgctggctggcagctttacctatacccaccatcaacgcagtaggtgtagcaagtcccaatgcacacggacaagcaatgacaagaacagaaacagccgacaaaataccataagagatatattcactaccaccaatggtaacccacaatacaaatgttagaatggcaatacccaacacgacaggtacaaaaatccccgtaatacgatcgacaatgcgttgcacgggagctttgctaccctgcgcttcctgcaccatagcgataatacgggcaagcacggtttcactgcctacctgtgcggcacgaatgataaatgaaccacgctggttgatcgttcctgccaacactttatcacctttcttcttttctaccggaaccggttcaccgctaatcatactctcatcgacatacgagtcgccttcggaaagctgaccgtccacaggtatttgctctcccggacgtacaactaccaaatcacctacctgaagtttctcaatcaagatctcctcctccactccattgcgcagaacacgagccgctttaggctgcattcccatcaacttacggatggctgttgaggtatttcctttggcacgttcttccatcaactttccggtaagaacgaaagcaataatcaccgcagaagcctcataatagacatgcggttccaatccgcggtcataccagaattcggggaagaaagtgttgaacagactgaacagaaaagcaatggaagtactaagcgcaaccaaagtatccatattgctccgtcctaatttagcctgtttccaggctccggtgaagaaaccacctccgaaaaagaccataacagggatagcaagtaccatttgaatctcattagagtatggcacatgcatcagtatcatggaatataccaacaatggtactaccaaaatccacgctccaattaccttccatttcaaacgagtgtaacgcttatgctgttcctcttcccggcgttcttctttgtgggcttcttccacaatcagatcataacctgccgcaagcacagccgcacgaatctctccgggagtcagctgctctttctcataagaaacggtcaatgtattggtagcaaaattaacggaagcctcaatgactcccggcaatttttttactgttttttctacattattggcacatcctgcacaatgcatattaagcacaggaaatgccttttttgttgtgttacccatataattatagtttacggccttcccctcctctcaaaaaaggagttggggaagaacctttgtttgtttatagaaacaagctaatacaggtatttgttcaattacttcttatcagccttctgatcgtctttttttgtttcttttacaaattcggcttcataactgaacttattaaaccctgcctgcaacttctttacattcgttttttcagcatcatacgtgatggttaccattttcgtttttacttcggtcgaaatatccttcagccctttctcaaaacgcatattgtcctttactttcttttcgcatttctcacagtgcatctgcgacactttaaatacaacaacacgaatatcttttgccaatacagctgttacactcaaaagagccaccacgcaagtggccatccatctttttgttctcatttttcttatcagtttaaaattaatattctttattatgtgatcgtttctttcatccgctatttcctgcttttactcactatttctagctaagttaaaacgtattccgatatatccttttgctccgtgcaccggtccccaaatcatggtagaatcaaagttgttcccccagggatttgccgcatcgataatcggattcttttgtttgaaatttgttaggttctcgcctcctacgtagatagaccagcggcggaagtaacgggtcacctgcaagctcaactgctcaaaactgccgtaacgacgttcccaagacaactgtccgtctccctgttcataaggagtaggcatcctaccgccaccattcagttgcagtgtggcgtcaaactgccatattcccagcggagtttggtaagaagccgtgagtagtcctttatatttgctggtcagcggtttctccattcgttcacctttgtaggtcgttttcgcatccgtgagccggtaagcacctgtcagagtgaatcctttgaagaaaggataacttgcttccacttggaacacatgcgaataagagcgtccatccaaattgtaaaaagctacttcatgggggttgctatccatatccactatcacttgtttcaggaaatccgtataatagtattctgcattcacattcagcgttttgccgaatatagggatataagtagagacgctggcaccgtagttccatgcttcttccatatccaggttctttgctatttccaccttacgactgctggaaagcaggtagttgttttctgccaacacatgattggtacggtacccttttccggcagaaagacggaaattcacataatcattcggattgtacttcagatgcgcacgcggagtcacgaagaaaccatgttcgttactgtaatcaccacgcagaccggccattaccatccatttatcattcaggttcaacgtatattgcacgtaagcaccgggaacagcttccttttcaaaggctttgagaggattgtccgttgtattttccaaacggtaatgttggtcataagcgtcataattgaagctcaaccctgcggagaaactattttgcggattaaattccgtttcaaacatcagcgaagcatagacgttggtttgatccacattatacagtttgcgtccatacgtagcatcctgattgtgtaaagtggtggaaagaatcaaagccaggttcgtattcttctccttattaaagatataagcattcttggtgaagaattcatagcgttccgtatcgatccctactttatacaggtcaccggagtgcattgtccctccatgattggcctgtccgctggtacgtgtttcagaaagggctttgatacctgcctggaaaacataatggtcgcccatgtatgcccaccggttccacacattatactgttccacctgcggaatatccacaaatccgtcatcgttgccatcatgcgccttggtctcattttcgtaatgcgccagcagagaagtgctccatcgtttggaaagtttcaatgtagcgtccgcattggcttcataccggttagtagtgcttgcaaaaagattggcagacacccaatcggcttccggcaactgtggtttcttaaattctacgtttatctgtcctgtgatggcttcataaccattcttcaccgaagatgttcctttggaaacctgtatgctctgcatccacggaccggggacatatcccaatccataaggagcggcggctccccgataattcggaatattttccgtcaacatctgcacataagtgccggacagccccaacaatttaatttgtttggctcctgttgccgcatcggaataactcacatctactgaaggattggtcacaaaactttcacctagattacaacaagcagctctactcaattcagcactgcttatcatatcttcattcatcacgctactgcgtaatttcatcgtccccagtttgcgagtgacaatattcacctcattcaattccactccatcacgaagcacaatatccaactgctgatttttgctgctcacatgaatggtatcattctggaaaccaataaaactaattattaacatgtggcttttggaaggttttgcaatagaaaaactaccatcttccttagttgtcactccttgtcctgtattcatccagaatacatttgcacccggaatagcctccccagtactatcttttaccgttccccgtacttgcgcatatatattaccggcaaataacaggaacagtcctattatcatatatttcattctttctaaagttactttcgagatacaaaattaattcatttctcatgcaacttagttgcattcagtttcgctttacttccatattcaatagaaagcaaaggaataaataagaaagaaatagtggctaaataatataagtggaatatagcgccagcttctgcctcgaacagagaggtggcggagaggtcagactatcatattctaccgatttatccgcataggtcggagtcaacagatagcaaaaatgctcacacaaaagatcgactactaaagctgatgttgtcagttcagtagtatgtttcatcaaatcgagcttatagataatagctgtacaacccttatctttacaacctttttttgaatcacaagtatgagtctttttacacttcggacagcctgtatcacaacagctctgcaccgtttcacaacggacacagcaataatgcacaatagagactccacctcctgaatagataatcaggagagaaaggataagtgctgttatgtaggctagttttttcatttcagaggacaaagataagaataaaaacaggttttcctataatttttcgtaattaagattcaatcaatccaatacagacacattctctttcctttatttggctattttagagtcatatcagcactattaactctttttactcaacaataaaacctatctttgccccaataaattctctgatttttaagtaaacgctatgcttacatatttactcatcattatcactctttatctggcaggtaatgcctacatatttatcagagcaaagcaagctctgaaagttaaatctctcggagtaaaaatattcctgaccgttttattctggatatgtgctttatcctttttcggcacaatgttggctcgcaaccttgagatgcctgtctttatctcccattcaatgtacatccttggaacaagttggttgatatttactctatacatggcattattcttgcttttgtttgatatcttgaaattattcaaagttgtctgcaaatataggttctatctgtctttagtgttcacgttgggattgctgggatatggggtatataactatcatcacccggaaaccaatgtagtcagcattttaaccaataaacgatatgaagatactccccaagcaattaaaatcgtcgcaatcagcgacgttcacttgggaaacggtacagggaaaactgcattaaaaaaatatgtggaaatgataaatgcgcagcatcccgacttgatactgattagtggtgacttaattgataatagcgtcgtacctctttatacagagaatatggcggatgaattggctaacttgaaagctcctatgggcatctatatggttctcggcaatcacgaatacattagcggtatcgatgaaagtatccgatatattaaaagcactaaaatacaattattgcgcgattcagtagttacacttcccaacggtatacaactgataggacgtgatgaccgtcataaccgcaagcgtcgttccctgcaagagttaatggtgaatatcgataaaagcaaacctatcattttattggatcatcaaccttttgatttggaagaaacaaaagctgccggcatcgacctgcaattcagcgggcatacacaccacggacaaatatggcctattaattgggtgaccgattatatattcgagcaaagccacggttatcgccaatggggaaacagccacgtgtatgtatcttccggattgtctctttggggaccacctttcagaataggaacgcattgtgaaatggttattttcaattttcaatgaatattatgcagttttgtcacatatgttacagtttctaagcaatctctgccctatctttgcagaaaaaaagattatggaacaattacatgctcatgaagtcctccacatgatggaaggaaatagctactcggaatcatcattgcgggaagcaatcattaagaagtttggctcacagcaacgtttttatgcctgctcggcagaaaacatggatgtagatacccttatcgaatttctgaaaatgaaagggaaatttatgtctgctgaagatggattcacagtagatatcactaaagtttgcaagcattgattggcggataatatccgccaatcccattttaggcgataaatagctgcaaatttttctgtttttattagcccggttcacgaatttcatctatatttgtcaatagtgaatgataaaacaaatgttgaatttacagaaaaaacgggtatgaaaaaacaatatgtcagtctgcttgcaattatactttcggtaagcggctttttgttttcttgtcatgacaagatgaacaaaaatacaggtgcgttacaatttgatagcattcaagtgaataagacagctcacctcttcaatgatacagccaaaccggcctgcaatattattattaattttgcttatccggtaaaatcatcggatgatatgctgaaagacagtctgaatacttatttcatttcggcttgtttcggagataaatacatcggcgaaaaaccggaagaagttgtaaagcaatataccgagaattatatcagcgaataccgtcgcgatctcgagcctatgtataccgaagatgagaaagacaaggaagacgaatcttccatcggtgcctggtattcttattataaaggtatagaaagccatgtgcaactgtatgataaagatctacttgtataccgcatcgactataacgaatacaccggaggtgcacatggaatttacatggcaacttatttaaatatggacctcaccctgatgcgtccgctccgcctcgatgatatttttgtcggagactacaaagacgcattgaccgacctgatctggaatcagctcatggcagataacaaagtgaccactcacgaagcattggaagatatgggatatgcttccaccggggacatcgctccgacagaaaatttctatctaagcaaagaaggaatcaccttctattataatgtatacgatatcactccttattctatgggacctgtaaaggtaacaatcccatttgctatgatggaacatctattaggcagtaacccgattctgggagagctaaaaaattaaaaatcataaaaagctgaacaccaatgaatatcctgttgttatcacttccatgtgacagaataggatattcatccacatctatcattcaaaacttataattcaaaattcaaacagtggaaatcatactgaaatattttcctgatctgacggaagagcagcgcaaacaatttgcagctctatacgacctctacactgactggaattcaaaaatcaacgttatctcccgcaaggacattgagaatttatatgagcatcacgtgctccattcattaggcattgccaaagtcatccaattccgccccggaaccagcatcatggacttgggtacaggaggaggttttcctggcattcctttagcaatcctgtttcccgaggtaaaattccacctcgtagacagtatcggcaaaaaagtacgtgtagcaaccgaagtggcaaatgccatcggactgaaaaatgtgactttccgccatgcccgtgcagaagaggagaaacgaacgttcgactttgttgtcagccgtgccgtaatgcctttggcggatttgattaagattattaaaaagaatatctcttcgaaacaacagaatgcattgcccaacggacttatctgtctcaaaggcggtgaactggagcatgaaacaatgccgttcaaacataaaacggtcattcatagcttgagcgacaacttcgaggaagagttctttaaaacaaaaaaagtggtatatgttccgatttaaacaagactatatgttctgatagatgataaatcatagagaaaccatgaaaataaaaagatttgaatttaatatgtttcccgtaaattgctacgtattatgggatgacactaaagaagcagtcgtaattgatccgggctgtttctatgaagaagaaaagcaggcactgaaaaagttcattcttaccaatgaactgaatgtaaagcatctgctgaatactcatttacacctggatcatatcttcggaaatccgttcatgctgaaagaattcgggttatcggcagaagcaaacaaagcagacgagtactggattgacgaagcaccgaaacaaagcagaatgtttggttttcagttgcaggaagaacctgtaccactgggcaaatacctgcacgacggagatatcatcactttcggacataccaaactggaagcaatacacgtacccggacattcacccggcagtttggtgtactattgcaaagaagacaactgcatgttctctggtgacgttctgttccaaggtagcatcggccgcgctgatctcacaggaggcaacttcgatgaactgatagagcatatttgcagccgtttatttgttcttcccaacgaaacagtcgtttatccgggacatggagctcccacgactatcggaatggagaaagctgaaaacccattttttagataataaaaaataagtatcaagcatcaagtattaggtattaacaaggcaaatcgcccattaactacagtaatacttaatacttgatacttcatactcgatactttaatacttgattattatgaaaaccgatttgttagctagccgtcacatcggcatcaatgaacaagatacagccataatgctccgcaaaattggcgtgaactcactggacgaactgattaatcagacaattcccgccaatatacggctgaaagagccgcttgcattgactagtccgctgacggaatacgaatttggaaaacacatcgctgaactggcagctaaaaacaaactatataccacatatatcggtttgggatggtacaacacgatcaccccggctgttatccagcggaatgtatttgaaaacccggtatggtatacttcttacactccgtaccagacagaggtatcgcaaggacgtctggaagcattgatgaatttccagacagccgtatgtgatcttactgccatgccactcgccaactgctcacttctggacgaagcaactgccgccgccgaagccgtaagcatgatgtatgccttacgctcccgcgcgcaacagaaagccaatgcgaacgtagtcttcgtagacgagaatatttttccgcagacattagctgtcatgaccacacgtgccgtacctcaaggcatcgaactacgtgtaggtaaatataaagattttgaaccttcaccggaagtgtttgcctgtattctgcaatatccgaactcacatggaaacgtagaggactattctgaatttaccgaaaaagcacatgccgcagactgcaaagtagctgttgccgctgatattttaagtctcgccctgctaactcctccgggagaatggggagcagatattgtattcggaaccacacaacgcttgggtaccccaatgttctatggcggtccatcggctgctttctttgctaccaaagacgaatacaaacggaatatgccgggacgaatcatcggatggtctaaagacaaatatggcaaactctgctaccgaatggctttacagacacgtgaacaacatatcaaacgggaaaaagcaacttcaaatatctgtaccgcacaagcattattagctactatggcaggcttttacgccgtttatcacggtcaggagggtatcactacaattgcatcacgtatacacagcattactgtatttcttgaaaagcaattaaagaaatgcggatatacacaagtcaacgctcaatactttgacaccttacgtttcgaattgcccgaacacgtttcggcacagcaaatccgcacgatagcacttaccaaagaagttaatctgcgctattatgaaaatggcaatgttggtttcagcattgacgaaacaacagatgtggcagctgccaatgtgttgctctcgatttttgccattgccgccggaaaagattaccagaaagtagacgacattccggaaagaagcaacatcgacaaggatttaaaacgtacaactcctttcctgacacatgaagtattcagcaagtatcacacggaaacagagatgatgcgttacatcaaacgtctggaccgcaaagatatttctcttgcacaatccatgatttccctcggttcatgtacaatgaagctgaatgcagccgcagaaatgttgcctttaagccgtcccgagtttatgggtatgcacccgctggttccggaagaccaagcagaaggttatcgtgaattaatcaagaacctaagtgaagatttgaaagttatcaccgggtttgcaggggtcagcctacaacccaattcgggtgctgcaggagaatatgcaggccttcgtgtgattcgcgcctatctcgaaagtatcggtcagggacaccgtaacaaagtcttgattccagcttcggctcacggaacaaatcctgcgtctgctatacaggcaggcttcgtaactgttacctgtgcatgcgacgagcaggggaatgtagaaatggctgacctacgtgcaaaagctgaagaaaataaagatgaattggctgcactgatgattacttatccttctacacatggtatcttcgagaccgagataaaagagatttgcgacatcattcacgcctgtggtgcacaagtatatatggacggagccaacatgaatgcacaggtaggattaaccaatccgggattcatcggtgcagatgtctgtcacttgaatcttcataaaacattcgcttcccctcatggtggcggaggtccgggagtcggtcctatctgcgtagccgaacatttggttcctttccttcccggacacggaatcttcggcaactcacaaaatcaagtatcagcagctccattcggcagtgcaggtattttgcctatcacatacggatatatccgtatgatgggtgcagaaggactgacacaggcaactaaaattgcgatcctgaatgctaattatctggctacttgtctgaaagatacgtatggaattgtttatcggggagctaacggtttcgtaggacacgaaatgattctggaatgccggaaagtacatgaggaagcaggcatctcggagaatgatattgccaaacgcctgatggattacggttatcatgctcctaccctctcctttcctgtccacggtaccttgatgattgaaccaacagaaagtgaaagtctggcagaactagacaatttcgtagatgtcatgctaaatatctggaaagaaattcaagaagtgaagaatggcgaagcggataaagatgataatgtattgattaatgctcctcatccggaatatgaaattataaatgatcgttgggagcactcatatacacgcgagaaagcagcttatcctatagaaagtgtacgtgataataaattctggataaatgtagctcgcgtagataacaccttgggagaccgtaagctactacccactcgctatggtactttcgagtaaaaagaggtctatccaaagagatttctagagcactgtctcttaaaaaatcacctcacaaaataattccgggactcacatacgttaagtcccggaattatttttatcagacaagaagctgtattctatctaacgatagttattgtattagcctttacctttttctcttttattggaatcttcgaatcaggataacccaaagctacacaaccgtagactttatgattggcaggaacacctaaagcagtaataaattcacgaacctccggatcatcacatgttgtccccaactgattgatccaacaagagccgatacctaaagactgggcagccaggaacatattttctatggcacaagcacaatccataccagcccaccattgagtaggctcattagatacaatcactaaagtcggagcatgataatagcaacaataagtcttactatgtccacgttcctgcaaacgagaatcgtcgctttttgcaaaagcccctttaatccgttcattcagttctgtcaacttatccatattttgaatagccgtaaaatgccatgtttccagatgcattccactcggtgcataagttgcagcttccaaaatagcctgcaaatcctcttctaaaacttgctggccagtataagcccgtacgctacggcgtgctttaatgttctctaaaacttcatttgttttcatggataacaagtattttatataagtatgccatcattattagtttaactgcatcaatacattatacttttctaccgtttgaccagcccaatctttgcattcagtttgaaataatagactccattctctctctccaggaacccgtatttgtctttctctaaagatcctttttctaaacgggtatttaaaaacaaaaaatcctccattatttgcttttccgatttatgataacagagcacttctccatttccatccaccaatagaataccttccactgccgaatccaatccattgtaaatctttgcaggacgcattcccaatactaatgccatcaagaactgcttcatcttgaattcatagaacttatgcttattgattagttcatctttaatcttcaacggattcatttgtttaataacttccgtcaactcactaatacgggagataccatccaaatgcatgatacgaaccatttctgtcagtacacgtggaaaatgcagatcaatcatcaaaagattactgcggaatacgcggtcggctacatcagcgtatttaagtacgccccccaaacgttcgatcatcatcatccgttcggcaacttcattcggagattcaggcaaagcattgattttattcactgttggagtggcaaatttgactccactctgttccagtttaagattcgctgcacgtcctccgtccaacaacggattcattacgcccaaccgtgaacggacattgaaacctcttaacggagctttcggatgccaaaatgcaatggaaaaatctgtgcgatcttctgtttttgcttccaaatcgaaaatggcagcttcgtctaaaaactcttctactccttccggagaaacaacatcattttccgacgaagatttcacagcctgtaatatcagatcagctacaataccaaaatcttcacgaggcatggacttactcccattctctccttctatacgaatcgtatcttcttcaatataatattgacgtgttccatcatgttcttcccgttgaatcattgcaacaggccaaaatgtatctcccgcctttgcttctgctgtgcctaacactacttttccatctgctaagagacgaaagaaagaatagagttcgcaccattcttttttggttgcttcaaatgccatatatttttgttcttctttattttactacaaatgttctatcttaattctactactgaattttcctaactatgagttgcttctactgattgataacctgcggtaaggttacagacgacacaaccggaggaactatatgagtcacctcctccaatggagggagcttgcctacctgtgcaaacagggagtttcgtatccattctctgggagtgactatgataaatcgtcccgtccaacaaccatcaaaataggaagggttacccggctgtttcttaatgggataacagatgttttctcctttagtccgcatctccggcgaacgtccgggatcattcacccacacatgtttatcatcaatgccacgaagcaccatccagtgccctctcggaccaggacgcaaaccacgaactgcacctgtatatctcacatttacaagcacaggaatgccacgatcaatataatctttcaatatccgataatctttctgctggaaatgttcggcacttatcatgttttcataataacgtgtcaacgaatcaatctcaaaagaataatatcctccctgccctattgaagtacggcgacggaaaggagcacgttttttcagaaagtagttccgctgatattcaatcagtttcttttctgcatcctgggctgtacgttgtgtatcagccgtcattcccttaaaataatcaaagaccattaacgaagaagccagagagcaatgcgagtaagggcatcccgcgattttctgcgaataccacggaacaggaatattattaggagccagtttttgagtttcctgtatttgtgcttgcgcctgaacgctcatccatacaaaggaacttaaaaacagactaaaaattatgtgacatttatttatcatgcaatccactctctatctctattactacttctaatactttacctacaaaatattctcatcatcaagaatccgcgctgtctccaccttctccaaacgtgcacgcaacttaggcatcatcgaacgacgaatccgcaatgtcatgctacaatccatgtcatacgactgattaagaatctccggttcctcttctttcacaatgcgcatgacatcattcataaaaggatattcaaacattaccgtcacatcctcatctaccgtcttttctataatagtagcggcagcaatcgcttcggcagcagcggccttgtaagcaacaatcaatccacttgtccccaacttgattcctccaaaataacgaactactataatcagtatatccgtcagttcattcgagtttatctgtccgagaataggtttacccgctgttccggaaggttctccgttgtcattggcacggaaatcctttcgcgcagctcccaacatataagcatagcatacatgccgtgcatcataatactttttctgatacgtttcaagatgcatctttatctcatcgagagtacgcacaggaagggctatagcaatgaacttgcttcgtttttccgtataaataccttcggaaggctcaatgatggttttataagtatcttcagcagtcatgttgcaaagatacggctttaatgagaaaagtcaatctatcatttggaaatattaatgttccacttatcgatgataggcagttgggggaattaaaaatagtgacgctatccaataaaaatagtgacggtataccacaacgataccgtcactatcccgggcatatcccgtcactattttttctacatcaatcaagcgtcacatctactgatatagtccctatcaacaatgattttcgcatcatcttacagatattttttaatctaacttatgaatcaccagtcccgaacgaagtttcggttcaaaccaagtagtcttcggcggcataatattgcctgtatctgcaatatccatcaactgtttcatagatacgggatagagagccaaagccactttcatttcaccgctatccacacgcttcttgagctctcccaatccacggataccaccgacaaaatcaatacgtttatcagaacgcagatcctttatacctaaaacttcatccaaaatcaagttggaagagattgtaacatcaagcacaccaatagggtcgttatcattatacgtaccggccttagcagtcaagctgtaccatttaccacccaaatagagtgaaaaattatgtaagccggatggtttatagatatccgcacccttctcttctactataaagtttttatcaagtgcagccaggaattgctcgggagtcaaaccattgagatctttcactacacgattataatcgatgatggttagctggtttgcagggaagcaaacagccatgaagtaattatattcttcatcaccacgatgattcggattttgctttgctttctctgctcccaccaatgcagcagcggcagaacggtgatgcccgtcagcaatataaagagcaggcattttagcaaattcggcagtaatggtagcaatatctgcatcctggtcgacaatccagaaagtatgtccaaagccatcacccggagcgataaagtcataaaccggcttgtttgctgtatatttctttataataacatccagcttctcattatcaggataagcaaagaaaacaggctcaatgtttgcgttgttcacacgtacatgtttcatacgatcctcttccttgtcacgacgggtaagctcatgctttttgataataccattcatataatcgggaacataagcaccgaccaccaatccgtattgcgttttcccgttcatcgtctgggcatagatataatagttttccttattatcctgcaccaaccagcctttgtcctgaaacagttggaaattctcggcagctttagcatacacccgttcgtcgtgttcatccataccaacagggaaatctatttccggtttaataatatgataaagagacttttcgttaccttccgcttctgcgcgggcttcttcagagttcagtacatcataaggacgtgaagcgacctgttctacgaggttttgcggaggacgaatgcccttgaaaggtttgattattgccatgatattagtattttatatgtaaaaaattaaagccacagacttcttgaaaatctgtggctcaaatatactacttatttctaaaaaagacattctgcaacggattgtttttattcagatactaccatagttatcctgaaaaatccggcagacttattcagaatcttacttgtttactctaaatttctcgcaaccatctttcaagaagcccacaatttgttgagcagcagcaataccggcattgatatttgcttcggcagtttgagcacccatcttcttaggagttgagaaataacgtccggcaaacttttctgcaaactctgcgttagcagcaggcataatatctgtgatatatttgaagtctgcacgctcttccatcagtttgattagttctgcttcgttaatcacttccttacgggcagtgtttaccaacatagcacctttcggcatatctttcaacagagcataattgatagagttctttgtttcggcagttgccggaatatgaagagataccacctggcaagtcttgtacaattcttctgcagaatcaagtgctttcacaccatctttttcgattacttctttcgggcagaatgcatcataagcatacacttccattccgaaacctttggcaacacgagctacattgcggcctacgtttccataagcatgaatacccaatttcttgcccatcaattctgtaccggaagttccgttatagaaattacggacagcatataccatcatacccaaagcaagttcggcaacagcattagaattctgtcccggagtgttcatcacgcatacattgtgagctgtggcagcagccaggtccacattatcgtatcctgcaccggcgcgaactacgattttcaattctttagcagcatcaagcacctctgcatcaacaatatcactacggataatgatggcattagcatctttcactgcatccagtaactgggctttttctgtatatttctcaagtaaagcaaactcgtatccggctgcttctatttctttacggataccgtctactgcaactttagcaaacggtttatcagtagctacaagtattttcataatctaattctgtttataaagactcaccacagattacccagattctcacagaataaaaaaaatctgcgtccgtctgtataatctgtggtgaaaatattattaatgaagtttttcaaattcctgcatacaatcaatcaaagcttgtacgctttctttcggcagagcattgtagcaagatgcacggaaaccacctacagaacggtgtcccttgatacctaccatacctctttcagtagcaaacttcaagaagtcagcttcgaagtctttgtattcgggagccatcacgaaacagatgttcatacgtgaacggtcttctttggcagcagtacccacgaacattttgttacggtcgatttcagcatacaacatatccgctttttcaatggcacgacgttccatttctttcacaccaccctgtgctttgatccagcgaagcgtctgcaatgctgcataaataggtacaacaggaggagtgttaaacatagagccactgtcaacatgagtctgataattcaacatcgttggaatgtaacgggaaaccttacccaatgcgtcattcttaacgataacgaatgtaacaccagcaggagccagattcttttgtgcaccaccataaatacagatatatttagaaacgtcgatcggacgtgagaaaatatcagaagacatatcggcaaccatcggaactggagaatcgagatctttcttcaattctgtaccgtaaattgtgttgttagtcgtaatgtggaaataatctgcgtctgtcgggattgtataatcttttgggatataagtatatgtagcttcagcagaggaagcaacttctacaacttcgccaaaccctttagcttctttcattgctttcttagcccatacaccagtgttcaggtaagcagcttttttttccaggaagttataaggaaccatgcagaactccatactagcacctccacccaggaacagtaccgaatagccttcggggatattgagtaattccttgaataatgcctctgcttcgtcaaccacaggttggaagtctttggcgcggtggctgatttccatcaaagagagaccagagccgttgaaatctaaaatagccttcgctgtatcctctatcacctcacgcggaagaatggaaggtcctgcattgaaattatgctttttcatttgaagtttgtttttggtttaacaatttcgttacttttgtcttttgaccttgcgaatttacgaatttatttccgccgtacaaatctttccttataaaaatactgttttaaagcagattttcctttctttttattggtttatacaggatatatacaccattttgttatccatagatgtcaagtaaggtatcttacagaaaagatctttacttcgcttcttctataatagtcttcattcctttgattttctccccctgaatcagattcaggagttgcttcaccttagcccggcgaatagctacgaaagcataatgctctttgacatcaatcgctccgacatcttcacgagtcagatttccttttttatataagaatccggcaatatcgatccgactaagtttctccttctttcctttacctatatatatagtagcccagaccgatttcggaggccggggagggttttcaggcaacactactatctccatttcttccggaatataagaaggaagtttctcttcggcatgaagaatcagataagacgttccggtcgcatcccaacgtgctgttcgtccgttgcggtgcgtaaaggcttcttcattgaccggcaaatgataatggatgatatgtccgacttctggaatatccagtccacgggctgccagatcggtagaaatcaagacatgacaactgccattacggaacttgtaaagcgcacgttcacggtccggctgttccataccaccatgaaaacgttctgcgagtagttttttatctgccaataactgatgtacacggtccaccgcatcccgatgattacaaaacacgatgctcgaactgcttcccaatgtacaaagcagattatataaagtatcaatcttatctttggaaggtgaaagcaccttcattaatttcaagcgcgactcttgttcttcagaatcgtccgaaaggaagtccaacttaactgtgcggttcaatcctgtaaattcgggaatctctgccgcatcagtagctgaaagtaacatacgtttttttaatcccggaagctgggtgataatctctgccatttcatcgtggaaaccaaactccaacgatttgtcgaactcgtcaataattaaagtttcaatggtttcagggttgaaattgcctttcgacaaatggtcggtgatacgtcccggagtaccgatgatgatagcaggatgattgctcaatatacttttcttttcttcggcgataggatgtccaccgtaacaacagcaggttttccaggaagtccccattgctttgaatacagaatctatctgtaaggccagctcacgcgaaggaacgagaatcaaaacctgcacgctgtcgtcgttcggttttagagtaaggagtaaaggtaacagataagccaatgtcttgcccgatcctgtcggtgacaatagtataacgtcttttcttccggtagcttgttcaagtgatgcttcctgcatcggattcagctcctcaatcttcaaattgcggagagccgactgtataatttcatttttctctaacatgggggcaaagatacaaaaaggaaagagtacggagataaaaatacaatcaaactttagccatgccggtcaatatataataacctttcagattattctctttcatgtaaatggttacttctgccctacaagctgtcaccaaggcatatcccgttaaacttgaactcatagctttgataaatgaatactctgtatcattgtgaataaaagatatacgatgatattccataacctattgtactttaataattctattgtgtagccaaatatacgaatataatagataagtacggataaaaaaggagaactatctttaaaacagacataaaatagatacaaaccataacggaaagacattatgagataataccaaaaagaagcgggaaatcgaagaagcattactgcttttcagatttcccgctctgtgtttatgtaacctttccggtcattgttccgaccggtttgttctcttctgcgaattatcctccgaagttgtcgaacatcaggttctgtgccggaacgccaagatcgtcgagcatcttctctacagctttcgacatcggaccaggaccacacatatagtattcaatatcttcaggagcttcgtgattcttcaggtaagtttcgtaaattacgttgtgaacgaatcccggagtgtacttcacgcctgcagcatcagcagcagggtccggacggtcgagagccaaatggaaagtgaaattcgggaagtccttttcgatttgcaggaaatcttccagatagaacacttcgttcagcgcacgggcaccgtagaagtaagacatcttacggtcagtagtatgcaatgtcttggtcaagtgcatgatttgcgcacgcaacggagccataccggcaccaccaccaatccacatcatttccttcttagaatcgaagattgggtggaagtctccgtaaggaccactcattattaccttgtcacccggtttcagggtaaagatataagaagaagcgatacccggcattacatccataaatccaggaccttgttctttcggtttgaacggcggagtagcgatacgtactgtcaacatgatacggtcaccttcggcaggatagttggccatagagtaagcacggattgtttcctcgtcgttcttacacttcagacccagcaaaccgaatttctcccatgcaggaagatattcatcaccaatcaagctcttatcgatgtccttgtcatagtccattgagaatttaggaatcttaatctgcgcataagaacccgggataaagtccatgtgttcgcctttaggcagagcaacgatgaactctttgataaatgtagccacgttcttgttggagattacttcgcactcccactctttcacaccgagtacagattcatcaattttgatagccatatcccccttcacttttacctgacaacccagacgccagtggtcttgctgctgtttacggctgaagtgaggaacttcagaaggcagaatttcaccaccaccttcaagcacctggcatttacattgcccgcaagatcccttaccaccacatgcggatgacaggaatattccgtttacagacagagtattaagcaaagtagaaccggaagcaacttccaattccttttcgccattgattgtcagtttcacgtttcctgatggcaccaggaaatttttggcaaccagcaagataacaacaagcaacagaataaccacaaggaataccccaatgctcgctaatattaaattcatatccattgtcttattcctttctttttagatgttcaaaccagagaaacacataaatgcgattgccatcagacctactgtgataaatgtgatacccaagcccttcaacggagcaggcacgtcagagtaagccattttctcgcggatagcagccagacctacgatagcgagcaaccaaccgataccggaacctaatgcataagaaagagcatcccatacatcaccgatatatttcgggtcgctcggaccaaggttgatacgttgttgcatgaacagagaggcacccatgatggcacagttaacagcaatcaacggcaggaagatacccagcgaagcgtacagcgaggggctgaaacgttctaccaccatctccaccagttgcacaataccggcaataacggcaatgaaaagaataaaactcaagaagctaagatcaacaccttcaacaatagcattggcagccagcaccttagtttgcaacaggtagttgaccggaagcgtcaccagcaacacgaaagtcacggcgatacccagtcctacggcagtcttcacattcttcgaaacagccaggtatgaacacatacccaagaagaatgcgaatatcatgttgtccacaaagatagagcggacgaataaacttaataaatgttccataattctttttgatttatgatttatgatttataatttatgattcagcagacttatcatgcgactatgactataaagctagacataaatcataattcagaaatcagaaataattaattactttgttcttgcaattctttatgacgtgcacgttgataccagataatgcatgctacgataatcaatgccatcggcggcatcaacatcaagccgttgtttacgtatccgatattttgaatcggttcataattcaggatattgaaaccaagcaatgttcccgaaccaaacaattcgcggaagaaagcaacgataatcaaaatcttagcatagcctaaaccattacctacaccatccaagaaagactcccaaggaccgttctgcatggcaaatgcttccagacgtcccatcaagatacagttggtgataatcaaacctacataaacagagagctgtacgcttacgtcgtaagcaaacgctttcaggatttcacttacgatagttaccaaagcagctaccacaaccaactggacgatgatgcggatgcggttaggaatcgtcttacgcaacagtgaaataacaacgttggcaaatgcagtaatcaccgttactgaaagtcccatcacgatggcaggctccagctttgcggtaacagcaagtgcagaacagataccgagcacctgtacggttaccggattatcaattcccagcggagcagagaatacttctttatttttctttgaaaacagttgtcccatattctatctttctcctccttattatttagttaaaaaactcaagtaactattcaggcaagacttcaacatggcatctacacctactgaagtgattgtaccaccggagataccatccacttggtaatcaggtttctctaccttgccattttttacgactcccaaagtgatagctccattttccaaagtcttcttacctacaaattcgttttggaaatgttcggttgcaatttcagcacccagacccggagtttcactagcgtgtgagaagtaagtaccgtaaacggtatctttatcttcgttcagtgcaacgtatccccagatagcgccccaaagaccggcaccgtaaacaggaactacatatttagtctgaccgtccacttcgcatacaaacacgtgcagacgttgttgttcttttgcttctttctcgtagttggtagcaaattcgcccgtattttcggtcagcgtaccgtctacgttcatcagcatatcccctttcacatatttctgatattcagcatccgcatcttccacattcttaatgttcaatgcagcgaggatttgtttcttagtgtccaactgcacattcttgtcttgtgtagatttcagtgaagaactaacgaatgccagcaggaatgctacgataataaccattaccgaagcataaatgatagtataactattactattcgtattcattttctttcggtatttattggttagacttgatagtgcgtttctcgcgacggctgatattgctttgtactacacagtagtcaatcagcggagcgaagatgttcatcagcaggatggcaagcatcataccttccggataacccggattcagtacgcggataacgatagccatcacaccgatcaggaatccgaagatatatttacctctttctgtacgtgcggaagtcacagggtcagtagccataaatacggcaccgaagcagaaaccaccaagaacgaggtgttcgtaccaaggcatttgagccattgtgttgttttccatgccgattgagttgaatacccatgccatgaatgcgccacctacgaatacggaaatcattgtcttccagcttgcaacacctgtccaaagcaggataacggcaccaatcaggatggcgattacgctggtttcaccgatagaacccggaatcagacctgtaatcatatccatgttgaatgcaggcacactgcctgatgtagcagcttgtcccagcggagtggcaacggtgagtccgtctacgctttgtcctaaaccgaagatactgtcgcctgacacccaaacggcatcaccggacatcttggtcgggtatgcgaagaacaggaatgcacgagtaatcaacgcaacgttgaatacgttcatacctgtaccaccgaatacttcttttgcgaagataacagagaatgcagtagctacggcaagaatccacaacggacagtctaccggaacgatcatcgggatcaagataccggaaacaaggaatccttcctggatttcttctttcttccattgagctacgacgaactcaatgccaagacctactacgtatgatacgattattttaggcagtactgccaggaatccgtagataaacatttcgatgaagctgccagtagcacctgtgtgagtgaaatgctggtaacctacgttgtacataccgaacagcaaagccggtattaacgaaataaccacaatcgacatgatgcgcttgctatcgattgcgtcatgtatgtgcgttcccgttttcgcagtcttgctgggcacgaacaggaatgtttcgaagccgtcaaacaccgactggaatgcgtggaatttgccgccctcctcaaagttcggctttatcttatcgagataatttcttaacgctttcatttatttaattgaaaattgaaagttgagagttgaaaattggctgtgctgggtttatgctgtatccacagagagccgtttcgcaagatttcaactatcgcttattttaatttttattatttaatctcttattcgattacgccatttctgaacggagcatatcgagtccggcacgaacgatgcgttgcagttccatctttgaagagcagacgaattcgcaaagggcgaagtcttcgggagctacttcgtagatgccgagtgcttccatacggtcgatgtcaccggcgataattgctttaatcagatattcgggcagaatgtccattgggaatactctatcgtattcacccgacataatcatgtgacgttcgccacctttgatacgggcatccaacgcatattccttcttacccatcaaccagctgaaataagaacgattggcactgaactggttgaagcgtggcatgatccatccaagcatttcgtgaatgtcgtcaccttcggggataacagtcagttggctatggaatgcgcccaagaatccgttcggggatacttgctttcctgtcagcacgttaccgctgatgtagcgtaaatctttgtcttttgttacattgccggcaaacacgttggtgagcaatgcgcctacctgtagtttgcagtatgcaggtttcaacacttcggaacctgtcacagctactgtacgggtgaaatctacatggcctgtattgaagaggcgaccgatgaagattacggcttgcggatcaatagtccataccgtttcgcccttggatacggggtcgaggtggttgatctgaacgcctacattacctgcagggttcggtccgtcgaatgcggtgattgtaacgttcttagcctgtgtcagtgcggcagcgttctgtttcacactgatgttcaggtaagtttttgccagtttggcaagagcatcaagccctgtctggaagtttgcttcttcgcctttgagggcgaactcgaaatccggagccaatggattggtatcgaatgcggagatgaagattcctttcggggttaccgtcggatctgcaatgatgtcataagggcgctgtttgataaacgcgaaaagtccggcttccaacaaagcggttttcacagcttcagcatccatcgaagcaacattcttcttcccaaaatcttcatagtcctgctctgcagcagcttccacaacgatgttcaacaccttacgacgagcaccacgttcaacactcgtcaccacgccgctcaccggcgaaacaaatttcacttcaggatgatacttgtcgataaacaagggtccaccagccattacatattcctgctctttcacgactaccttaggcgtcactccaggaaagtcatcgggtacaagtgcgtagaatcccggttcttttactgttgcgtacgtttcagcagcttttcctttcaggtttatgtcaaggcctttacgtaactttattacatttgccatgctatataaaataatggtttcataaatttgccgcaaaagtaataaataagattgggattcgggaggaaaaaagaaaggaattacggaaaaatatccgtaattcctttcgtgttcgtgcacgtaatcttttatcttttgttccggaacaaaagacagaagcaaagaaaaagaactattcagcaaacataggatcccaagcaggaagtcggataggcttctgtttcaacacctcgagagcttttttcgatgcatatttcgtttctactactaggcggaacatatattcgttaaaccaatcatctgtcataatgagataaccctgataaccggcggcgggtccccaactattttcaaccatccatttcgtcggttttccatttttgtcaagatcgacggccataagagtcatggcgtgactggagccactggcaaaactttggatacgttgcttcttgttcatgccaaaagaagtacccataagagattcgtagtcgtagtttttgacatccagcagaccacggtcagagtttagaaacttacctacatcgcaagaaaaatacatcatcgtgctatccttgagagaagaaatagccatttctttgatatcctcgatgggaagattgacatacgtccagtttttgccgtcgtaacggtggcggtcgtaatctatctcataacacttataatattcacggctcggatcgttcattaacatgacataattatcaatcagtttttcgtcaccatactttttcaggaaagaaagcggagtgtaagtttcggtagacacaggctcacccttagcgttatattcagtccaggtaaattcagtaggaggaacaccgagattcaacactaacatgcggtagatggtgctcaacatctctgtttttgttttctcaagggcagcaggcttggcaccttgcgcagcgagaccacggagttgaagcccctgttcacgaagtttcagggcgatcaggcctgccatacgggaggtattttcactactgttggtttccggcatcacatctttgggaacaagcccgtatttactgacaatatcggctacaccggtaaatgttccaccgtcactcaaaggattgcggaagagccattccaccattttatcatccatcggcttactgctggtgtcgataataccttgcagaaagagattagctttctccagctgatcgaagaagaaaggataagtttgcgaaaattcgaaagaaccgaggttatgcttggcgatcgctttggcacgcatcacattcaaacctgtgaaaagccagcaacggccggaagatttctgatcggtgatacctttggaaggcactttgatggagaaatgtgtgtccatccctttcaggttatcctgattgagagccagtttacgaatgtcgttgctaccgatagcgttgcggatagccttgtcagtaggagtgtttgcgtaactctgcttgatttgttgcatcatggagtcgctgatgcctcctttcacttcttgcgcttgtgtagaataagaaaaagcacataaaacaaaaattgataaaatctgtttattcattgatttgatattaaaatgttgtcatatttcaccttcttataatagataaaacatattactcttttgcaaaggttgttgaattcttagatatatgcaaacaaactcctaaaaaacgaataatattttttagcaaacaataataacttattgtagaaaaacctgcagatagaataaataatcgtatatttacacacaaaattaaaacacaacaaaatgacaagcgcaaaatcagtacgatataattggattgactggagtaagtcaatagctatatttctagttatttggggacatgtaccaatgcaatcagagacgcacacgatcatctattcctttcacatgccacttttctttcttatatccggttacttatacaaccctaaaggaacaataaaagaagaattatataaggatctcaagactttgctgctcccctatctcatctatcaattcatattttacccgtattggtttgttagagaacttatagtacctcatcaagtcatcaatatacacaatagtatcatacaacccctcattcaatcactgtcgtcagaccccattaacggccccacatggtttatatattgcctgtttatgataaaaatatattcctacactatacaaaaaaaacaatcaatatactggttgacggcaggtatcagcagcctagtctccatactcatttgttattggctcaaccaacactccatctatggtacctatgctacacatagtttttttgcattgcaaatattcttttttaccggacaagcattgaaacggacaaagataaaaaacatcgcaaattccttgcatcaaagtatcatctggctgattttatccattgtttcatttgccacatttttttcgatgggatacaccagtaactatacaacactgcccgaaatagtaaatttccacctcctgagattcaccggaagctgtatgattcttggaatcggatttatactcaaccaaattacatccaccataaattataatgtatcaataggcacaatggttattttaggtatacattggatgttcataggtgtattcaattttgctatagaaaaatacctgcatatcgataatattacctactctacattcatagcctttattataagtctacttattacagcaatcaattatccactcattatattctgcaagaagcatatccctctactgttaggaaaaatccgcataccaaaatagcctttatttgcccttagaatgacttttttagatttattatctaagaacttcaaaactaatcaaaataaaagagttttctttgcagtcgaattcctcacagagaaattatgaagaaatatataataggaatattgatgatgcttccatccatcaatatgatgtcagccgcggctgatagtacggcagtaaagagcgatgaactgcaaaggtctacaacttctatcagtgatactactcctacagatattgaagacatcccgtcagataccattcctgtcctttcaaagcgcgagctgcgtcgccagcgcgtggcaaaccggaatttacactataacatattgggtggtcccagttatacgccggattttggtttactggtgggcggtagcgcactgatgacattccggatgaatccgagtgataccacccaacgacgttcggtagtgccgatggccattgccttgatgttcaaaggcggcttgaacctgatgacaaaaccacagctcttttttaaaggcgaccgcttccgtatcttcggaactttctcatataaaaatacaatcgaaaatttttatggcatcggatattccactaataaagattatgaacgtggagaagataccagtgaataccgttatagcggcatccaagtaaacccctggttcctgttccgtctgggagaaagcaatatttttgcaggtccccaagtcgatttgaactatgataaaattaccaaaccggctgccggaatggttaatgagccctcatatatagcggcaggaggaacagaacacggatacaaaaatttcagttccggacttggtttcctgctgacgtatgacacacgtgatattcctgcaaatgcatatagcggaacctacctcgactttcggggaatgatgtataacaaggtattcggcagcgataataacttttaccgtttggaaatcgactaccgccaatacaaaacagtaggacgccgcaaagtgatagcctggacagtgcaaagcaaaaacgcattcggagatgtacccctaacaaaatatgtacttagcggaacccccttcgatcttcgcggttactacatgggacagtttcgcgacaagtcctcgcatgtcatgatggccgaataccgccagatgataaatacggacaaaagcacttgggtaaaaaagatgttaagtcatataggatatgtagcctggggaggatgcggattcatgggacccactccaggcaagatagaaggtgtgcttcccaacctcggattagggttacgcgttgaagttcaaccccgtatgaatgtacgccttgacttcggcagagacatggtgaacaagcagaatttgttctacttcaacatgacagaagccttttgacgccatttacgcgacaaattgtgcacaaattacaagaaagattgtaaaatagataataaaagactgcacataaatgaaattaatccttatatttgcgcaagctataacacagcaagagcaaataataggatttttttatgaagcaatttatatgttttttttcggggttattacttctgttcgtctctaccactcgtgtagttgcacaagaagtgtctgactattctcaactaagtgaagaagattatactaaaatagtgcttccccctctatccgttttattcgaaaatgccaagaacagccccatttatgagatggcggacgtaaaggcgagaatcgagcgcaaattactccaaaaagagaaatggtcatttctgggtttcttcagtctacggggaagctatcaatacggaatgttcggcaatgagtccacttatacggacgtggcactcgccccatacctcacctactccacccaggcacaaaatggctacacagtaggtgccggtctaagcatccccttagacgacctattcgacctcaagggtaaaatcagccggcaaaggctcacattacgcagtgcagaattggaacgggaagtgaagtacgacgaaatcaagaagaatattattgagatgtatgcgatggctacctcacagataagagtacttaaaatgagaagtgaaagtttggtacttgctaatgtgcaatatgaaatttctgaaaagaattttgccaacggaaccatagaatcttccgacttggccgtagataaagaaaggcagtcaactgcacgtgaggcatatgagaatagcaagtttgaattgacaaagagcttaatgatacttgaggttatttcacgtactcccatcataagaaaataaaaaaactaagatatgaacttcatcatttctatcatacggaccctctttcgccaccgttggctaatactggtagggaccgctatcttcacgttactcgtcttctactatacgcgtcacatgcaaggtggatacgacgtgaaagcaacactttataccggagtagcctcgggatacaacttggaaagcgataaacgcacagactgggcgacagtacaaaattcgatggacaacctgataagtatcatgcaagccgagagcaccctgaaaagagtattcctgcgattatttgcccgtgtacttatccagggaaatccggacaatgacaacgacggagtcaccccatccagctacaattacacctataaccacttaaaaaacagtccgcatggaccggaaatattaaagctgatcgacaaatcgagcgaagataaaacagttgccaatctggaagcatatatgcgtccgaaaaaaggtaactacatctatgaaatgttctactacaatcaccctttctatagctacaacgctttgaaaaacgtcaaagtgcaacgccggctcacgagtgatttgctggacatcagctatacttccggcgatcccggcatagcctacaacacggtaagcatcctgatggacgaatttgtggaagaataccgccgtattcgctacggagaaacagacaaagtcatcaaatactttgaggaagagttgaaacgcatcggcaaaaaactcaactcggaggaagacgacctgaccaagtacaacgtagaaaaacgtatcatcaactatctggacgaaaccaaagaaatcgcggccatcagtaaagaattcgagctgcgggaacaagatgcactttttgcatacaacagtaccaagtcaatgctcgaagaactggagaagcacatggacagcaatgccaagcaagtgctcaagaatatggaatttgtggacaaattaagagaagcatccaatatcaccagcaaaatctcggaagtggaagcaatgagcgactccaaacaaaaagataccggatctctgacaggtgacaaaaaacggttgagcgaacttaaacaagaattaaatgatttaaccacttcctacgtaagtcacaaatacaccaaagaaggtgccagccggaccaatatcatcgaccaatggctggaacaaaccctgttgtttgaaaaagctaaggccgaactactaattgtacaaaatgcccgtcaggaattgaacgaccgctacgtttttttcgcccctgtaggtaccaccatcaaacaaaaagaacgctccatcaactttacggagcgcagttacctgaccgtgttacagagctacaacgaagccctgttgagaaagaaaaatctggaaatgacttctgctacattgaaagtgctcaatgaaccgacctatccgattgcatccaattcaaccaaccgcaagcagattgtcattgccgcctgcataggtagttttctgataatcatcgctctattattattaatcgagattcttgacagaacgttgcgtgatgcaaaccgaaccaaacgagtgaccggatttaaggtaataggagccgttcccagcccctcctcttcccgttatggcggactagccaaaacctacgtccaactttccatcaaagaattgagcaactccatactccgcttcctgacgaagcggaaatcccccggagtatttatcatcaacctgttcagtaccagcgaaaactccggtgaagacatcgttggaaatctgatctgcggatatatgcaaagccggatgttaaatacgagattcatcacgtatggagaagattttaacacagattctactcaatacctgcttgcaaaaaacattaccgatttttataccctgcaaggagaagacatactgatcgttgcctatccgccattgtcgtcaagcaatatcccgactgcactgttgcacgacgctaatgtcaacattttggtcagcccggcagaccgcggatggaaaaccatcgacaaacaactttgcgaacagctcacgacacaaatgggtaaaacggatgttccgttccgtgtgtgcctgaccaacgccaagcgtgaggcagtggaagatttcaccggacaacttccgccatataccttattacgcagagtcagctatcgtttcagccaattgtcacttacagaaaaaatcatattcaatctaagtagaaaagcgaaagagactgaagaagacgatgacgaataataagatagtgactttccatatcctgcttgctttacaatttgtgttggttgcagcaggaatgttagtaaatatcaaggtagggttattctctatgatcattatcttgtcatttactactatctgtttgatacaacttaacaatgatgaacaaaccaactggaaagcaggtcaaaacatcatgacctatatgttcacaatctggttgtgcttctatcttctcgaaattcttaatcccaacaacgtgctggcagcatggaacatcaaccttacaccttatgcgctgatacctttaatatgcgcctttgttgttccgctcgttgtccgcacaaaaaaagacatcgagctgctattaatcatctggtcggtattcgtcctcgtctttacgataaaaggttactggcaaaaaaactatggtttcagctccaaagacctctatttcctgcacgtgctgggcggatggcgtacacatatcatctggtcgggtatccgctatttttcctgcttctccgacgcagcaaactacggagtacatgccgctatgtccgctgtagtctttgccatctccgccttttttgtggagtccaaatggctacgtatttacttcctctgcatcgccgtcgggggactttacggaatgggtatttcgggaacccgtgcagctatgggagtcatcatgggaggaatgttgatgataaccgtcattgccaaaaactggaaagcgttattggcaggtatattcatatccatcagcgttttcgtgtttttcagttataccaatatcggaagtgggaaccaatatatccacaagatgcgctcctctttccatccatctgaagacgcttcctatcaggtgcgtgtcgaaaaccggcaaaggatgaaagaattgatggcaaagaaaccgttaggctacggcattgggctttctaaagccagtaacttcgactcacgagagcaaatgccctaccctcccgactcctggctagtcagcgtatgggtggaaacgggaattgtgggactgatactctacctttccatacacagtattctctttgcctggtgttcctggatactcatgtttaaagtacgcaacaaaggcctgcgtggacttatcgcggcatggctctgtatggatgccggattttttatcgccacttatgtcaacgacattatgcagtatcccaaccagttgcccgtatacataggctttgcactctgttttgcagctccacatatcgacaagcgcatcagtgaaaaaaaagaagaaagcgaagaaaaagaacggcagctatctaataacgaaatcaacgaacaagaatgacaaacaatagtcccgacatatcatttattaccatctgttacaacgggttcaaagacacctgtgaactgatagaatcactgcacaaaaagctgaagtctgtgagctatgaaatcatagtggtagacaatgcttcacgcgaagatgaagcagccaaaatacacgaattatacccaacggttatcagcatccgcagcaatgagaacggaggtttttccggtggcaacaacattggcatccgtgcagcaaaaggcaaatacattttccttatcaataacgatacctatatcgaatccgatgaaatcgcctacctagtggaacgattggaaagtcgtccggaaatcgggggcgtgtctcctaaaatacgtttcgcctttccgccgcaacacatacagtttgcaggatttaccccgctgacaaagataacattgcgcaacaatatgctgggtttcgactgtcccgataacggaagttacgataccccccatcctaccccctatctacacggggcagccatgattatcaaacgcgaagtgatcgaaaaaatcggaatgatgccggaaatcttcttcctttattacgaagaactcgactggagcacaagtatgacccgtgccggctacgagctatggtatgagccgcgttgcactgtttttcataaagaaagccaaagcaccggtcaactaagcaaactacgcacctatttcctgacacgaaatcgcctgctctatgcccgccgtaatatgaaaggcatggaacgattaatgtccgtactttaccagagcaccattgcagccggcaaaaacagtctgtcatttgctttcaaaggccgtttcgacctgttttgtgccacctattatggagtctgcacagggctattcatgtcttcatcagatactaacaatagcacacttaaaaaactctagatactatgaacattattgactggattctctacattcccctggtattttgcgtatgctacctattactatacgctattgcctccaagttttaccgggctccccaataccccgaagcccgtacgctccgacgcatcgtcgtgctctttcccgcctacaaggaagaccgcgtgattgttgcttccatacagagctttcttgaacaggattatccgaaggaactctatgagatcatagtcatttccgatcagatgcgaccggaaacaaacgacgctctggcaacccttcccatccgcctgttgatggcgaattacaaggaaagttcgaaagccaaagcactggcaatggccatggattccattgatacaaatgcattcgacattgtagtcatcatggatgccgacaacataaccacgcccgatttcctgtctaccatcaaccgtgtttttgacagcggcataaaatccgtacaggcacaccgtacaggaaagaatctgaacacagacatttccgtactcgacagcgccagcgaagaaataaacaatggattcttccgcagcggacataacgctgtaggactttctgccggcctatccggttcgggaatggcattcgaagcagaatggtttcatcagaatgtgaaatatctccagacagcaggtgaagacaaagaattggaagccatgctcttgcaacagcgcatctataccgtttatctacccgacctgcttgtgttcgacgagaaaacacaaaagaaagaggccatcagtaaccagcgcaaacgctggatagcagcacaattcggtgcactccgtgcttcgctgcctcacttgcctaaagcattcatacaaggaaatttcgactactgcgacaagatatgccagtggatgcttccgccacggttgattcagttggcaggagttttcggcttgaccttcgtctttaccgttatcggccttatattgagcctatgcaatggcagcaacgaatggatgatagccatcaaatggtggatattgtcggctgcacaagtagcagccatgatgctacccgtaccgggcggcagactatttaccaaacaggtagggaaagcaatcacaaaaatgcctatgctggctcttactatgattggtaatttatttaaactgaaaggagccaataaaaagtttatccatacggagcatggtgaacaccataaatagaaatcaaacataacaagaaaacaacaatgaaaatcgctattgaagctcaacgaattttccgcgctaataaacacggaatggatttcgttgctcttgaaagtatccgggaattgcaaaaaatagaccacgagaacgaatatttcatcttcgttactcctggtgaagacagatgcttgaaagaatcggagaatgtgcatattatcgaactaaaatgccccacttaccccctttgggaacaagtggctcttccacgcgcagtaaaaaaaatcaggcccgatttattgcactgcacaagcaatactgccccattgcaatgtcccgtaccattaatactaacactacacgacattatttatttagaaaagcgtcattcttccagcttcacctggtatcaggaaatgggatggttttatcgacgaatggtagtaccacgcgtattggccaactgtgagaaaattatcaccgtctcgcagtttgagcgtgaacgaatccttgacgtgttgcatctgccggaagaacaattagtagccgtgtacaacggtttcaacagtcatttccatgtacaacccaaagctccggaaattacccgaaaatatattgatgcaaacaattatctattttttctgggaaacaccgacccaaagaagaacactcccagagtgctgaaagcatatagcgactatctgaaacaatccacccaaaagttaccattgctcattgccgacctcaaaggagatgttatcgaccagatattggaagaagaaaatattagagaaatcaagagttatatccacgctccgggatacattgcgaatactgatcttgcggcactctattgcggtgcattcgcattcctttatccatcgcttcgcgagagtttcggcatcccgatgctggaggcaatggcttgcggaacgcccatcattgcgggaaacacatcagccatgcccgaaattgcaggcgagggagctttactggcagatccgttcaactccaatgatattactgaaaaaatactgcaactggaaaatgaccagacactctatcagcaacaagtggaatatggcatacaacgtagccagttgttttcatggcggaatacggcagaatcgctgctgaaaatatataaagaatttgccaagtaaaataccaaaaagcaataactaaatcaaaaagagaatgtgtcaaaacttccctttttaacgaaatcaccttcgccacagatagttgtagcgaaggtgattttatctaaccattccactcggctttcacctcgaaacacggacatgccttaatccattcttcgggttcaatctctccgtttccattcagatcggggctcaaatcccgatgtccgcacacccggcagccgggataatcacgcaagagcgtaagaatcagtacgtgcattgaatgaacctgccattcggtacgggtatcggcaggatgaccgtggcaatcaagtccgccctcataacagatgccaatactgttctggttgtgtccttttgcgtgcgcaccgattcgttcaatctcacgggtggtctttatatctccatttttgcggatataaaaatgataccccgtcccgttgaaaccacgccgacggtggcacacttccaaatcatcttccgtaaaattcctatctacccttgaggcggaacagtggatcacaatcaaattgatggttcgcataaattcatccctccgtttcagcgaccatctgtactcgttgcacacattccttgctgctacactgcagagccgcagcctgcgtcaactgtcctctcaacgagaaaatctccgcgtgcatctctttcactttcgagctaaggtcgaaataatccttcaacactttctccaactgctgcatcagaaaagtatattgatctttcactagttcgctgaactctttcacttcttgcgccatcatctggcgcttcttacgactattgccaagaaaaggcagaatcgtcatgatgatttcgataattttatctaacattttaatagattgagatgataaattaataaattgagaacagagtcaatcaaagcggtttatgctgccggatccggagcttctcctccaccgctaccaccaccgggttctcccccatcgcctttaccatcatcatcggagccgtcaccgccgtttcctccggcagcggacttcttctccgcatacaattcaaacatcatgttattatccccgccacgagtagttgccgtgctgtcattggcaagacgcaatgagttgtcgactttgaaacggagattgatgcgagtgatatttttcaccgtacaatccttttcctgttccacacccggacaggtcagcgtggtataaaaaatacccagtccatccactttcaccttattccctgccacaagcacttttttcatcgcacggacaaaggatttcatcacatgcgacacgtcttccaccgaaagcgacccgatagactcgatttcctgtgccagtgaatcaattgaatagattttcgactccccagccttgggcttgagaagatacatcatcggtgatttatcatcaccgagccgttttctgcgcttgtagcgcacaactgtaactgttgccatatttaaaaattgtttctacgaaaagaagtacattctccctttctgttgatgaaacaaagatacgacaacacattgacgacttaccggattgcaccggactacaccggactacaccggattatgccggattaaaacggattacaccgaattataccgaaatatgtggaaatatgtaggaatatgtaagattattccctagttttcaatgatccattctccaatagttcgcgtactactgtcgaaattaactcccactttgataactttccgatgatctgcctgataaggaatcgcatactgcttactattgatctgtgccaacgcttcttcaggagtaccgtctactttgaattcgaatacatagatagcctcctgcatctttatcacaacatcagccctgccaacagcgctctttacttctgcatccacatattgccccatcaaccggaacaggaggtagaagatggtctgatagtgtttctcctccttattattcatatcattggggatagaggcgaaaaatgatttgatccgctccatacattgatccagattgccgacccgtaagtctttgataaacgatactacataaaatgtattctcgcgagcaggcaaatgcacataagccggcattaatgattcgataaagcctttccgaacttctttgttaggataagccaacgtatagatctgaaaatcccggtcatactctttgatagtgagataaccgctttggtaaagtaccggaagcgggtctgtaatgacattggtaggtgcatcaaactgctcggcagtagccgaaacgccatccagttgacgaatatcgaaatcgctttgctgcaagatgtctatcaagaaagtaggagtgccggtagaaaaccagaaattctcataacttttctgcgcaaatgcattaaataagctaaacggattgtacacatcctcacatttcttactgaaatgatacccatcatactgttgcttcagatgcatacacgcttcatcatacgtttcaccattcgcctcggccatccttcttatatcttcttccaactgtgtacgcaattcattttccgttataccgcaaatgccactataagcatcttgcatacttatgttctgaagattgttcaattcactaaagatgctcatctgactaaatttactgataccggtcagaaaaagaaaacgaagatattctccctgcgctttcaacggactgaaaaaatcgcgcatgatgccacgtatttcagcttgcaactcctcattgttgttgctatccaacataggagaatcatattcgtctacaagtaacacaacctgacgtccgctctgctcgtaagcacgtttgataatacctttcagacggagactgaaagtgtcttcgctcgtatcacatccgtaaattcgttcccattccaccaagcgattgttgatagcagagcgcaacattcccgcatccatatacttactgatgctgaaatcaatatgcaacacgggataaaccgtccagtctttctccaactgttccatcatcagccccttgaacaggtcttttttaccagagaaataggcttcaagagtggaaactaacagactctttccaaagcgtcgagggcgactaagaaaacaagtcttagccgaattagtcaaacgataaatcaactctgtcttatcaatatacacacaattattattgcgtaaatcttcgaaactctgtatccctatcggataacgcctgaatattccttccatcctttttctatgcttttaacgtgaaacgtaaacaaagatacgataaatttcaagaatcggtattctattagtatcaattcttttatgaatacacccgaacatccgttctcaaaacttgcctattccactaaaaatgagtaactttacttcaaatacagcaacctaaaagcacaactataaatgaaaacaaaaaacaagattctccccgaaaaagaagaggaaaaaacattccaataccgcacctatgggaaaggcgaacttgccttgttgtacctccccaatatcctgcaacaaagcgcagtagaccgattcaacgaatggattgaagctgcacccggactaaaagaacggctcctggccaccggcatgaatccacgcagcagatactacactcccgcacaagtaaggctcatcgtcgaagtactccaagaaccctaattgaagtattaagtattaggtattaagtatggtaaacgcatcgcaacaatggataacatcataatacttaatacttgatacttaatacctaatactttaaaacagctctttttcaggtagccagcaggaattgtcgaacattgtatttcggacacgctggtcagcggagagagaagggtcgtgagattcttcacagggcaggtatcgtccgcttacgggatcgtagacaaaggatgccattccaccgacaccaagatgcttgaatttcaccttgtccacgtatacgcgtgtgacaccaacctccttgtcacgttccacaatgataccgtaatccgctttgttatagaaatcggcagagccgttgatgtcgtacatttccacacgaggggtaatgcccgtgacaggattacggttcattttacgaggatggactacgaccacgagcaggcaattatgttgcacggcaaattctgtaaatttattcaacaggttcgaaatatattgcgtttccgtctgtccaggctgcgggttatggtcgaaacggttgagcgggtcgaagacaatgatgcggcagccacggcggacaacgagttcatgagccttggccagtacacgatccggagaaacattacctttcagagaaatatgagagacgttttcagtcagaaaatcttccgagttcgcaaggagtccctccgtcatgccacagccgttttgaaaacggtgtccggtaagtttctcaatcagtttgcggagatgatagacgatgggggtattttccgggctaaagaacccgattttccattgatgccgcaggcagagacgcaacaccaattcgtccacccactcggattttcctgcaccgggaactccggtgacgtagacacttcgcccacgttcatacgtgcagatcttatccatctcctcccatcccgtttccgctccgggaccgaagccgttgtcgaaaagagcccgcagatcgtcatgcaagtcggcagcggtgaagataccttcgagcggaacttctgctgcctgttcgatggcgatacggagactggcgataccatatttgcagagatgctcgttggcatctttacactccggaccgtaagtcaccacccggcagcgttcagctcccagccggttgatgagttcattgcgcaaccggattccggcagaatcagcatcaacggcaatgatgatttcttccaggtcctcgaagtgcgtctccataaaacggtcgagccaggagaggttcgaattggctccggccggcacggagatggcgcttttgaatccggcggcgatggaagaagcagcatccagttccccctcgtggatgatgcaggaggtttgccccaagatggagtcgatgttgtagggaatcagttcggcaccctgcaccattttgaaaagtttcgggagagcgcgaaatttggtgtttatcagttgttccccttcaaaatagttgaaacagatgcaacgttcctttttgccggattgcggcataaattcttcctgttcggtgatacgcagggcggctatgacagactgcgggatacaacgcgtctccaccagccaacgctccgtgtcttcggaaagtgtggttttcgaggcatcaaacacaggacgctgaaaatgctgcggaatggctgccgcacgacgcttgcgggctgccacacgttcggcattcttgcgctcttccacatcatcgggaacataaaaatcagcgccacaatgataacagtgacagtggcccgtgtcgacgttgacacgtagcgaacggtcgcgcttattcttgcgggtaggaagacattttttacaaatcgtcttgaggactccactcgatttaccgtggatgtcgacatcatagttggcaaaatttctcatatttttttccttttttctaattaaaaaatagtttaaaataatcattcacacgcagaggacttacctgccggacgagtgtctgccacctgccggacgaacttccgttacctaccggacgaacatcggcaacctgccggacgaagccagtcatctgccggattaatgcgcccatcttttcttcacatcatcccacacagccgatgcatcgggacgtggcggcgcatcaaccggaataagatgtcccagatacgttcgccgcccgtcgacgacgctttcaaagcggttcacatccttgtcgaccgtattctcaagctctttcagcaaggtttccctcaacgtgcggcaagtaacggaaccggccgcgatataatttgaaaaataccgtttcacgtcctccgggaaaagcagtccggctcctttgtcataaaggcggatatgttttttgaagatttccagaataagtttttgatggtctacaaaaagctttcccaaaccggaatgctgcccggccaattccatatatgactggaaagtagaaagttggtccaccaacttttcccaaggcaacacgggttgtaacggacaatgattgccttcatccgccaaacggctcacaagagacggtgtttctatattactcctattattgtttacaacagaaacacttcctttactctcctcttctttactctcctcttctctcctcttctggttttcagtgggttttctccctttactgacgggcgtttcagcactttttgccacctttttcggacgccctccttttttaccgttttcgatgtccattttccgcttctcttccaagcttttcatcaccctatccaagtaggaagaacgaaacatctgtcgttcctcatccagttcgaagagatcgaattcgcgaagtacccgctccaccgcaacttcatccacatcataccgccgggccatggccttcagtaaaaccggtttgcacgacgcctcataagtatctttagtgcgcagatgcaacagcaacatcacgtaaattccgagtgcttccgcggcattcatttccgtcatcatacaggcaatattgtcgtcattcaacaaatttacctccaaattgaaatactgatctttcttcattttcatttatcatttattattccacatttaatacttccggggcgcaaaggtgcaaaatgtattttattccagctatcgcaaaaatgagagggggattatatattttttatccgacctttgccaaaaattattaataatcccaaacaatatggacacaaaacgcaaccaaacgttggaagaaatagaagaaaataaaatagtgaacgagcattaccagaacagaataatgctgataaaaaagctcctgaaaacgtcacggctagccacagtagacctctgcgtgcatatcgacatcagtgaagcctcctactaccgttacataaatttcaccagctatatgaaagcagacattttcatacatgcttgtctcttcctcaagcaatatattgaaagtcaccacattccttatacccaagaagaaaaacggcttataaaaacattagacctgtttcagatttcctcaaatagcaacttaaactgcaattaaaacacagaaaaggagaaacttatcataagttttattacatttgcaatgtaataaaggtctttaaaacttaaaaaatgagtgatagcgaaacagacagcccatcaataaaagcactgatcgttttcagagaaaacggagaaaccgacaatctatttgttcctatcttatgcgatgctatcagaatggctggaatcgacgtgcgatgttccacaaaagagttttgggaatcggataagcattatgatatcatacatttccagtggccggaagaagtggtgggatggacatgcaacgatcctgatatcatcaggcgtctggaagagcgaatcagtttttttcgttccaggggagcacgttttgtctacacacgccacaatgtccgtccgcattacgcaaacggaatcatcagccgggcctatgacattatcgaatcgcagagtgatatcgttgcacacatgggacggtttagccgtgacgaatttctcacaaagtatcctgacagtcagaatgttgtcattcctcatcacatttaccagtatacctataaagaagatatcagcgtagagcgtgcacgtcagtatctcaacctctcgcaagatgcattcatcgtcacagctttcggaaaattccgcaaccgtgaagaaatacgcatggtgctcggagctttccgcgcctgggacgaggagcacaagatgctgctggctccgcgcctctaccctttctcgagacgcaacagctatggcaggaatttcatcaaacgatggatttcaaaagccggatactatctgctcatgccgctgctcaaccgtatgtataaactacaggcgggagctaacgacgaactgatagacaactgcgatctgccctactatatggctgcttcagacgtgatattcatccagcggaaagatatactgaattcgggcaatgtccccctcgccttcctctaccacaaagtcgtggtgggtcccaaggtgggaaacatcggcgaactgctttccgaaaccggtaacccgactttcgatcccgacgacaagaaagacatcctgcgagcactcgaagaagcccgccggcttgccgcatggggacaaggggaagtgaattacacatacggtatggaaaacatgagcatccgcaaagtgggacaagcatacgcgcaaacatataaacaggcaatcaatggctaataacattaagagtcaattattttcgggggtattttacacagcgctggccaaatacagtggcgtcctcatatcccttgttgtggcgggaattctggcccgtctgctatcaccggacgacttcggcatcgtagctgttgccaccgtcattatcgctttcttcaatcttctcaccgacatgggagtgtctcccgccatcgtgcagcacaaatcgctaactaaagatgatttgtcggatatcttctcatttaccgtatggacgggcatcggaatcagcatcctgtttttcgcttcttcgtggatcatcgccgattactaccaaagtgacaccctgcgcatcctgtgccaactgctgtccgtcaacctgttcttcgcctccgccaccatcgtgccgggagccatgttctaccggaataaagaatttaaattcattgctatacgtagcttcgtcattcagatttcggcaggtgcagccgcggtaaccgccgccctctgcggagcgggattgtacgcattgattatcaatccaatcgtatccagcgtactgatcttcgtgatttcctttcagcgttacccgcaacggttgcgtttcacactcggactgacggtactccgaaagatattttcctattccgcctatcaattcctgttcaatgtcatcaactatttcagccgcaatctggacaaactgctgattggtaaatatatgagtatgtccgatctgggatattacgaaaaatcgtatcgcttgatgatgctgcccttgcagaatatcacgcaggtaatcactccggtgatgcaccctatcttcagcgatttccagaatgataagggaaaactgttgagttcctacgaacgtatcgtccgtttcctcgcctttatcggtctgccacttagcgtgctgcttttcttcacggcagaggaagtgacgcttattattttcggcgatcaatggatgccgtccgtacccgtgttccggatactgtcgctctccgtagggattcagattatactctcttcgtccggctccatctttcaggcggcaggcgatacacgaagtttgtttgtgtgcggagtgttttcgtccgcgttcaacgtggcgggaattttgctcggcatcttccatttcggaaccctgacagcagtggccagttgcattgtggtgacattcaccatcaactttatacagtgttattggcagatgtaccgggtgaccttccggcaaagtgcctggccgttcatccgtcagcttatttctccgttggtgattagcattttgatagcattagccctcattccaatgcagtatgcgctggaagggatgaacatttttgtgacaattattgctaaaggtatcgttagttttattatctttggcatttatatacagatgacgcatgagtatgacatgatcggtaaagtgcggtcgttaagaaaaaaaagtctatagctatgaatatacgcgacatttttataacgctacgttataaaataagttatggtagcactgtggaatggtacaatttctggtacatcgtcttgcggaaaaagagaaaaatcataccgcaagtagcttccatcgacgaaacgatacgtaaaatcatcgacgaccgttgctctgtcagccgttttggcgacggtgaagtgttgctcaccagtccggacaaggaaatccgtttccagaaaggtgatccgttattggctaaaagactgaccgaagtgctgcaaagtcacgaagaaggacatattgtctgcatctccgacgcattccgcgatttgtatcgctacaatcgcaaaagccgccggttctggaggactcatttttatctgtacggttcgtggtgggaccgtttgctggtagcgggacgaaaatattacaatacattcgtcacccgtccttatatggactttgcccgcaaagaagattccgcccgatggtttcacgacatgaagggcatttgggacaaccgggacatcgtcttcatcgaaggggagaaaagccggctcggagtgggcaacgatcttttcgataatgcccggagcatccggcgtattctctgtccgcccagagatgcattcgaacgcctggaagacatcaagcgggaggcctgcaaagtggaaaaagaagccttgtttctgattgccctcggccccgcagccactgtgttggcctacgatttgtttaaagccggctatcaggccatcgacgttggtcatgtggacgtagagtatgaatggtggcggatgggagcccataaaaaagtgaaactggaacgaaaatatgtcaacgaaactgccattggcagcgaagtggcggatgccggagaagaataccggaaacaaatcatcgcccaaatcgtttgaggaagaaaaaacagtttgagaaagaaaaaacagaataaacaattattgaatactgaaaataagaatgaaagctcttttccttatatttcacggcttcaatgaggccaacggaattagtaagaagatacgttatcaggtgaaagccctcaaagattgtggagtggatgttcgcttgtgtcattatgatgtgacctcttatggcgaacggcgttggatggtggatgacgaagtgatcgccgatttcggcacgggctttgccgcaaagatttggaaacgtgtctactactctcctattcttgactatgcacgccgcgaaggaatcgactttgtatatatgcgctcttttcacaatgccagtccgttcaccctccggctggtgaagtcgttgaaacgtacaggcgcaaaagtggtgatggaaattcctacttatccttacgatcaggagtacgtcacccgttccatgaaatttcatctggccatcgaccgctgtttccgtcacaagctcgcaaaggctctggacggtatcgtcactttctccaatgcggaagaaatatttggcggaaacaccatacgcatctccaacggaattgattttgaggcgattccgatgaagaagcagcagaatgacacttcaaaagagttgcacttgatcggagtggcggaagtgcactactggcacggcttcgaccgccttgtgcgcggattggcagattattaccgcaacaatccggaatataaagtatatttccatattgtaggcccgctgtccggcgaacgggaacgggcggggatcttgcctgttgtccgtgacaaccatctcgaaccgtatgttcttctgcatggtcctttgcatggcgacgaactggatgcgatgttcgaaaaagctgattttgccattggcagcctgggacgccaccgcagcggaattacgtatatcaaaacgttgaaaaaccgcgagtatgccgcacgtggcttcgcgttcacttactcggaaaccgacgacgacttcgaccacatgccgtatgtatggaaggtggcacccgacgaatctccggtggatattcagggactgatcgacttccggaaaacgctgaaaatgacgcctgccgagatacgcgaatcggtctgcccgctatcgtggaaggcgcaaatgcagaaagtgatcgacgccataaagaccaaagataaataaacaaaaacacaattaataacaaacaatattctgataaacatgaaaatagcctactgcatccccgccctctactatcctagcggcatggaacgggtattgacactaaaagcaaattacttcgccgaagtgtttggttatgaaatacatatcatcctcacagacgggaagggcaagaaaccgtactacgaactgcatccgtccatcactcttcatcaacttgacattgattatgatgaattgaacggaatgtcattctataaaaaactacctaaatatattgcgaaacaaggacgttttaaaaagaaactcaacgaatgtctgcaccaaattcgtccggacattactatctccctgctccgtcgtgacatcaatttcatcaatcggatgacggacggcagcacaaagttgggtgaaatacactttaacaaatctaattaccgagatttcagcaacagccgtctgcccgcattcttacgggcaatcgtaagcaattattggagagagcagttataccggcaacttcgccagttgaaacgtttcatcgtattgagccacgaggatgcacaggaatggacggaactggataatgttgaagtgatccataaccctcttcctttttttcccgaccaaatatctgacaatagccataaacaggtaatagcagtagggcgatatgttccgcagaaaggattcgaccgcctgatcccggcttggcaactcgttgccagaaagcatcccgactggatactgcgtatctacggagacggtatgcgtgagcaactgcaacagcaaattgactctttaggaatcactgccagttgtatattggaacctactgtttccaatattgtcgacaagtactgtgaaagttcaatttttgccctttcatcacgtttcgaagggtttggaatggttattatagaagcaatggcatgtggcgtgccgcccgtatcattcacctgtccctgcggcccgcgggatattatcagcgacggaaaagacggtctgctggtagaagacgggaatatcgaacaactggcggagaaaatctcttacttaatagagaatgaagatatacgtaagaaaatgggacagcaggcgcgtatggacgtccagcgcttccgaatagaaaatattgccgaacaatggaaacaactatttgaaagcctgattatcccggttaatgaaaacaaataaagcattcaatatctatggaatggtattctaagtatttacaggtttatgagaaaccttttgcggaagctccgcaagccgttatcgaggaagtacgccgcaatctggccggattgcagagtaacgaaccgcttgtcactgtatcactcatcggatacaatgaggaaaaacatctgcttgcctgcctctggtcgttgagcgagatgaaatgtaaatatcctgtagaaatcattggtgtggacaacgaatcgaaagatcgcactgcggagatttacgaggcttgcggtgtgccttatttcacggaaacgcaacatagttgtggttttgcccgtctttgcggactgaaccatgcccgtggaaaatatcatatcaacattgattctgacacgatgtatccggcaaagtatgtggaaacaatggtggatgcgctcgaaaagccgggtgtagtggctgtcagctcgctttggagttatattcccgacaaggatcactcttggatggggctgaaaatctatgaggctgcacgcgacttgcatttatggttgcagtctttcaagcgtccggagcttagtgtgcgcggactggtatttgcttaccggacggaatgtgcgaggaaaacgggaatccgcacggatattatccgcggtgaagacggatatctggctttgcagctcaagcaattcggaaagattgcatttgtacggaaaagacgtgcgcgtgccgtcaccggatatgggacggtgggagccgacggaactttgttcaatagtttcaaggtgcgtgtcgtcagcagattaaaaggtatcggaggactgttcacccaaaagaaggaatataaggatgaggagagtaatctagtaaaaaagaagtaagaaaggaaagcctatgtgcaagaatctcaatatcggtatcgttttatttttaattattggcttagttatgtcgggatgtatccgcaaactgaatctatatcaaggagataaagacgaggatgaaaacaaggataatggaaagaggcgggatgtcatctgcgaaacggaattcatatacccgttcggtaatgaaacagccgataaagaaatagaaataaccattcacctgaaagcagacagacaggtaggatatctgtatacggaaataccaacattgaaatataacaaagattggctgtttctgatgacacaagacgactgtatgcattcagccttttcatatacatgggctgccattcatggcaaacctttatcttatatttactactgcgatctggctcatctgcaaaacggtgatttgcctcctgattattattcattaggaaaaacattagctaccaccaatggtaccggacaggaagtacgtttctctttcggaactaccgtggctgccgatgatgatttaatgaacacacaaacatgggtacaaaatggatatacaagagattatttccgcttttataaaaagacaatgttagtatggggcaacttgcaggaaatgatgaattacggagtaagcatcgctttccatgacttgaatctacctgacgaagataaaacagaagataagttgctggcacaatttcctgttgctcaaagcatgatacgtgagaaactgaataatcgaacttgtaaaatgctggcagagcctaatggagataaaaattatatcaaagcggctttgagatatgataaaatcagaaccctgtgtgcacaaagcggagctacaaaactctatccatttcaagaaaacggagatattgaacaagtagtgatcgaaagagctttctatgacccacccgaaggtagcgggctgacaaatccggatatgattaaggcggctattctcaaggaaatggaaaatccaaaagaagagcgggcagctatttctataggtgcccataatacagataccggttgggtgaacttcttggaatggctcaacgacacatacggacgagatggtgacgactctatgtggtttaccaaccaggaagaatattatgaatattattactatcgtttgcacagcaaaccggaaatcaaacaggtaaatacgcacacgtggaaactgacactaaatctgaatggagaggactccgctcctttctattacccttccgtgactgtaaatattttcgggcttaaaatggaggacattgaaagcataaaatcaaatgaagatgttacaggactctcttatggtgaccataaagatttcttcatgctaaatatcgactgccgaaaatacctggcggaacacgccgagaatttcgtgaaacgatatgaagcgaatccgacagatgtttctgccaaagcggacgccaactactttgtgaatatgctgaaagattcggataaaaagacggagttgaagaaacgaatcgaataaatggccggacgcaaaacgaactgttaagctatttgggcataaacgaataaaaaagatggaacgtagagaaagaaaaagaagaagtaataaacaaatataattatgaacgaaaccatgaccctttgtcttgaaattattttctggcttgccctgttcgttgtgttctacacctatttgggctacggaattgtgctttatattcttgtcaagttgaaagagcttttcgtgaagcctgtgaagcgttcgttgccggcatcggacgcagacctgccggaagttaccctcttcattacggcattcaacgaagaagatgtagtggacgagaagatggaaaacagtcttgagctggattatcctgcggacaagctgcacatcgtatgggtgacggacggaagcgatgacggtacgaacgaacgattgcagacgcgttggcaggggaaagcgaccgtacatttccaaccgctccggcaaggtaagacggctgcaatgacacgtggaatgacgttggtggatactccactcgttgtttttacggatgccaacacgatggtgaaccgggaggcaatacgggaaatcgtgcttgctttccaggatccgaaagtgggctgcgtggctggtgaaaaacggattgccgtgcagacaaaagacggggcggctgccggtggtgaaggtatttactggaaatacgaatcaaccctgaaagcacttgatgcacggctctactctgccgtaggagcagcaggcgaactgtttgccgtgcgtaacgagctgttcgaagcgatggagccggatacgttgctcgacgattttattctttcactccggatcacaatgaaaggttacaccatcgcttattgtacgaatgcttatgccatcgaaagtggttcggcagatatgcgcgaagaagaaaaacgaaaagtgcgcatcgctgcgggaggattgcagtctatctggcggcttcgtccgttgctgaatcctttccgttacgggatacttagctttcaatatacgtcgcaccgggtattgcgatggtctattactccgttcctgttgtttgcgctcttcccgctgaatattgcgattctgctgttgggtggttccacgatattttacggagtgctgcttgccatgcaggttcttttttacgggttgggatattggggatattacctatctacgaaacagataaaaaacaagttgctctttatcccctactactttttatttatgaatgtcaatgtgctgaaaggcatccgctatctcaagaagaaaaaaggaagcggagcttgggaaaaggcgaagcgcgccgaaaagtaagaacaaatgccataatcttttgttatccttataggagacataagtctctattatctaataaagaacagacatggacagaatattacatgatgcgaataacgcacaaagaatattgaaactgacggcagatacaatgctattggttgacaggcatggcgtctgcgtagacattgagcctcattgtgatctatggtttctgcaagaggatatacttttaggaaaaaatatatttgagcttttaccggaatatacaagagagagggtgatgcccatctttcagattgtgctcgaagagcagcgtagcatcagcaagaacttcaagctggtgctgaatgacgaaattttctacttcaaatgcctcatgtttccgtatgatggcatggtgctttgccaatatcgcgacatcacgcaaagaagcaatgtaaaaagacggttggaacaagcaaatctcaccctgcgggccatccaaaaggtagcccagataggacaatgggcgtacaatacgaatcagaatattttccattatttgggttatacaggcgttttgtgtgaggaaagtgtgcagaatctcgccattgaaaaatatgtggaactgattgtagaagaagaccgtcagagtttcagggaatggtgtcgggtgaacgaaagggagctcaacatggagagcatcagctatcgcgtccgactgaacggggaaatcttctatatgcgtatccagacttatttgcgtgaagagcgccccgacggcagtttcaacatcgaggggtatattcagaatattacggacatacagcatcgcagaaatgacatcaatacgttgacgcacgctatcaacaacgccaaagagagtatctttgccgccagacccgatggcacgattatcttcgccaatcgtcgtttcctgcacaatcacggtattcccgaaagtgaggatatcagtcagttgaaaatctacaatgtcgccgcagatatgcctacgcaagaggcttgggacgaacgttgtaaagatgtcatacacggtggcagcagtaactttgtggctcatcatccatcgaaaatcaataaaggtatattggcttacgaaggtacgatgtacaacgtcaccaatgactccggagaagaaagttactggtcgtttgctcatgatatttccgagaggattcgatacgaagcccaaatcaaacggctcaatcaaatcatggatacgacaatcaataatctccccgcggggattgttgtgaaggagatcaacaatgatttccggtacatttatcgaaatcgggaggcttataaccgcgatctttacaagaacgatcctgtcggtaagaatgacttcgatttctatccgcctatcgtggccgagaagaagagacaggaggatattcaagtggccaccagtggaaaaggtatgcactggacggtggaaggaaaggatcggaacggaaacctgattatccttgacaagcggaaaatccgggtggatggggacgaactgtcttcgcctatcatcgtcagcatcgaatgggatgtcacggaactggaaatgatgaagcgggagctactgtcttcgaaggaaaaggcggaaatgtctgatagtttgaaatcagctttccttgccaatatgagtcatgagatacgtactccgctgaatgctattgtggggttctcgcatctcattgccgaaagtgatgatgcggaagaacgaaagacgtactacaacatcgtaaacgcgaacaacgagcgtcttttgcaacttatcaacgagattctcgatctctcgaagattgaatcgggaactatcgagttttccttcggaccggctagtctccataatctctgccgggaagtgtacgatgctcatatattccgtactccgcagggagtaagccttgtctatgagtcttcggacgagagtctgatgattgaaacggacaagaatcgggtattccaggtgatttcgaatctgattgggaatgctgttaagtttacgaaagaaggaagtatcagttatggttataagctggtggataaccagattgttttccacgtaacggataccggaacaggaattgagccggagaaagtgggtcgtgtgttcgaacgttttgccaagctgaacaatcatgcacagggcactgggttgggattatctatctgtaagtctatcgttgaacggctcgggggcaagatttccgtcagctccgaatttggtaagggaacgacgtttacatttactttgccgtatacggttgcagaatccgtgagtgtagattcggagaaaaagaatgatgatgagacaagcggaggtatgagcagtgctgtaaatacacggcatgcttgtattttggttgccgaagatacggacagtaactttgatttattggaggctatcttaggtaaggagcaccggattattcgtgcgcatgacggaatggaggttgtcacgatgttcgatgaggtgaaacccgatcttatcctgatggatattaaaatgccgaatttggatggattggaggcaacgaaaatcattcgggagctgtctgccactgttcctatcattgctcaaagtgcctttgcttatgagcaggaccggaaagcggcgaaggaggccggatgcaatgattttatagctaaaccgatagcggatgataagctgaaagctatgattcataaatggttgtcgcctccgtaaaagggcacatattatagagtacatattgtatagaaaacgctttaatagtgatataatcacccaataacttagattagatgaaagccttttacagactgttttattacatatccatcgtgctgaccagtattttggcaggagttaccattgcgggcgccttcgtaggtaatgccgcaccggatagtttcaaatttatgcctttcatcggtttgatgttaccgatacttttgttggctaatcttgcttctgtcatctactggacgatccgttggcggtgttgggttttcatccctctgattgctatattcagtaactggagctatattagttgtgtgattcaatctccttttttcagcccggcttcggctccaatggtcaaaatgaacgcgtatactcctggtattttaactgttgctacttacaatgttgacgcttttaatcatgagcataccggttattcatgcaaagagatagcctcttacatgagaaatctgcaagcagatattctctgttttcaggagtttggcattaatgatgagtttggtgtagacagtatagctgcggttctttctgattggccgtattattatatccctatttctcccgaaggaaaacatttgttgcagctggctgttttcagccgctaccccatcaaggaggagaatcttatcgtctatcctgattcgaaaaattgcagtctctggtgtgatattgagactaatgcccgtactatccgcctgttcaacaatcatctccaaacaacggaagtgagccagaacaagcgcaaactggaaaagggactccacacggatgattctcaaagggtggaacgtgctgctttgggattgattgacggattgcatgagaatttccggaaacgtgccgtacaagctaatactctaaagcaactgatagctgcctccccctatcctactatcatctgcggtgactttaactctctgccgtcttcgtatgtttatcacactgtaaaaggtgataagttgcaggatggctttcagacgagtggtcatgggtatatgtatactttcaagtttttcaagcatctgttaagaatcgactatattctccattcaccggaactgaatagtacggattacttctcgccggatcttacttatagcgatcataatccggtggtgatgagggtgaagttataaaagagtaagaggatgataagctaataatcatatccttaaagatattccgtttatatcaaaatcttactgataataaaaaaggctgtcccgaacacgagacaacctttcattattttgagattttatcgaattaatggaatatataacgaagactaaactgaacagagtaagtagatctaaaatctttatactttgtatacgtttcagtcaatcttttgccactattcttttggaatgtatatcccttgccttctccagtagtactatttcccttatcgtaagccaagagattggtattatttacggtcttatacaatccccaatctgaatttaacaaattcaagaagttcttaatatcaacaccaaattgaagagtatgacgtttaccaccaactttaagatagaaatcttgcataaatttcaaatccaattgatgatgccaaggcataaccactccaccgcgatctacatattcgcctttgtgcttcttcaaatagctatcttggttgatatatgcccaaaagtcatctttttgttgatctgcactataaatttgcccgtctaatttatagtcatcatatgttctatttacactattatatgttttttccgcaaatgtccaattattcagctcttctcttgaagcaggaatatataataagttattagctccaccatcgccaacaatgttgccagcaaatgtataggaataacgagcataaccataaccaccagcatatcccatattcattccttcataaatgaatgataatgaggaagcaaatcttttagcatattccaaacgataaccagctgaagctacaatacggtgaggagaaacataggtaccataacctgtttcatgttcattaataccgcctacagaataagtatttgttctatatgcagaagttacctgatcaccaataccatcactgtacgccttagctttcgaatgtgtatatgctgcagacaaatacaagccaaaatcaaaagatttagctaattgagtagtaatagaataataataggccttgtgaccaccattctctatatagaatacattctgttttccacctgcgtttgtccatgaagcatcagagtatttgctatatgagtcacgtgtatcattcggattaaaagtgatcgtagcttctgaaggcttaatagctttattagaaataacggcaggattgatgtctttattaaaaataccttctattgagaaatcaatatcccccggaagtttagcatcaaaggctaaagaggttttccaagtagatggcatctttaaatctttatcaataatagttggatctgtaggagctttaatatcagcaattctaccattcggatacaattcattcaatactcctgatacagaaggttgaaaatgaggtttcaaagctgcatcagctaccttagtataataatattgattctgaccgacattagagtttccaaccgcagatactaaccatacaaatggtaaacgacctacataaagcccagtacctccacgaagaacatatttacgctcaccggtaatatcccaattgaatcctacacgtggagacacagaaatctttgcagaaggaacttgatctgtagagtagcttactccgccaaactcacatcttgcaaaatcttcattatagttattctttagagaaggatatttaggcatctcaaaacgaataccagcagtcaacttaaagttctcactaatattcatctgatcttgtaaatacaatgaatattgcaaagttttcatttcagccttaaattggctataatctgccgcattagagtgtgtgatagcaaaagccttaggatattcattatttacgaagctatcccatgatttatacacataatatccattaccagcttgttggaaaccatttgtagccttgttatactcaaactggaaaccagccaataaattatgaatacctgccgtataagacatttcatctgtgagaacaaatgttctggcttgagctaagttgcccggagaaaagatatctggtccaatacgtgcataaacagcaccgtcttccaaaatatcaattgatggaaaatctgctgctccctcatagcttcttggctcatcttggaaggagtaagtgacacgtgtcacattattcaaactaccatctaaccattttgagttccattctgaagcatacgatgtaaagttatattccttgaagtaacgagaattttcaaaatacatagcagcattatgattcacattcccagatcctttggaagctgctgttccaccatcataaatatctgttgcatagaaaggagaaacagaagaagttgggccactattatcttttgaatgggcacgtgtaaaacggaaattgagtttattattatcattaatattccagtccaaacgtgccatgatcttgtaggccggagtcttgatagagtatccctgataacgtcccggatcatagtcatacttgtctataaaatagttgcgaatctcatccatctttcctactgtaggacgattcacattggctgtattagatccccaatcatcactgtcgcttaaacgagctctgctcttaggaccagctgttacattatcttcatattcaccgtttacaaagaaaaacaacttgttttttatgattgcacctccaaaactagcgccatagaggtatttttgagatttctcacgtattaactctaaatcacctaccttatcaccattcaaattctcattatttaaataagtataagctgttgcatagaaatcattggtaccacttttagttacagcattgattgccccaccaatgaatccactttggcgaacatcaaacggagttacagatactgctatttgttccaatgcatccaaagaaataggtgaacctccgcccggcaagttagaaccgataccaaatgaattactgaaagcagcaccgtcgacagttacagaagactgacggtaattaccaccacctacggcaaaaccattacctgtgttagctccttgcggagttaaacgcataatatcattcatactacgtccaacagtagggatcatagccatctgctcttctccaatattagtaatagcgcctgcacggtcactcttcatattgctgttttttgaagccgtcaccacgatttcatctaacaattcagagctttcttttaaagaaacatttaaaacataattctctcccaatgaaaggttaattcccttgtaaattgctgtttgataaccaacataagaaatttctactttgtaagggccgccggtacgcataccctgcagattaaattgaccactgacgttagtcactgtaccataacgagtgcctgatggttcgtgaaccgcaacgactgttgctccaatgattggttcatcttgtgcggtcactttaccactcatcgtggctgttgtaacctgcgcgctcatcgtgacagcaataaacaacattactagcactaagaaagatcgcattctctttaacataaatgtagttgattagttaatataaattgtttgcttttaaaaactgtgcacaaatataattaataatatttagaactacattacgattatactacatttttttaagagagataaacgtttcactaccttataaaatgataaaggctctacaatatttgcagagccttttattttgaaacagaaagcattagaaatgcttcaatctattactttatactagtcagtcattaactttctataacgaacacgcttcggctcttcatttcccaaacgtttcattttgttttcttcgtattctgaataagacccttcgaagtagaatacattggagtctccttcaaaagccagaatgtgtgtacagatacggtcgaggaaccaacggtcatgcgagataactacggcacagccggcaaaatcttccagaccttcttccaaagcacgcagtgtgtttacgtcaatatcattggtaggctcatcgagcaacagtacattgccttcttctttcaaagccatcgccaagtgtaaacggtttctttcaccaccggacagtacaccgcaaagtttttcctgatcgcctccggagaaattgaaacgggaaaggtatgcacgcgcattgatgtcacgtcctcccatgcggatcaactcattgccaccggaaattacttggtaaacactcttattcggatcaatatctctgtgttgctggtctacatacgccacctttacagtctctcctacttcaaactctcctttatctactgtctccaatcccataatcagacggaacagtgtcgtttttcccgcaccattgggaccgatcacaccaacaataccattaggaggaagcataaagttcaaatcgtcaaacaatagtttatcgccgtatgctttggccacctgtttcgcttcaatgactttattacccagacgcggaccattcggaatgaagatttcaagtttttcttctttctctttcacgtcttcattcagcaacttgtcataagagttaagacgtgccttaccctttgcctgacgggctttcggagccatgcgcacccattccaactcacgttccagtgttttgcgacgtttactgacggtcttttcttccatttccatgcgttttgtcttctgttccagccaggaagagtagttacctttccagggaataccttcaccacggtctagttcgagaatccatccggcaacatgatcgaggaagtaacggtcgtgcgtcacggcaataaccgtaccttcatattgctgaagatgttgttccaaccagtcgatagattctgcatccaagtggttggtaggttcgtccagcaagagcacatccggtttctgcaacaacaaacgacataaagctacccgacgacgttcacctccggacaggttttctaccggctgatcttcaggcggacaacggagagcatccatcgcacgctccagtttgctatccagattccatgcatcagtcgcatcaatgatatcttgcagttcgccctgacgggcaaaaagagcatccatcttatcctgatcctcgtagtactccggtaaaccgaacttctgattgatttcttcgtattctgtcagtgcgtcaacaatgggttgcacgccttccattactacttcttttactgtctttgtgttgtctaaataaggttcctgtgccaagtaacccacggaatatcccggagagaacaccacttctccctgataggatttctccaaaccggcgatgatcttcaataacgttgatttaccggaaccgttcaaaccgataataccgattttcgctccatagaaaaacgacaggtaaatgtctttcagcacattcttattgggggtgaaagccttgctcactcccaccatcgagaagataatttttttatcgtcagcagccatacgtatgattatatattgttgataatggcacaaagataagaaaaatgtttgaattcttttggagttataaaaaaatgttctacctttgcacccgcattcgaaagaaagcactgaaggaccgattcgctagctcagcaggtagagcacaacacttttaatgttggggtcctgggttcgagccccaggcggatcacaaaaacaaaattaatcccttgataatcagtcgttatcaagggatttttcttttaagattcttcacatatacttactcaacaagcatagaacgacacggcagttcgattacaaaagtagtaccgatccccagttgggaatcaactaatacccgcccgttcatcttctcaacgattagtttgcagatagataaacccaaaccggccccttgagcaaaggaatccaacttctcaaacctttcgaatatcttttcaagcatattctgcgggatgccccgaccggtatctttaacaccgattctgacagattggtggtctacctcatagaagacttccacatgtccggtggtagtgttctttaaggcattcgaaagaaaattactcaagatctgtttgatacgcaggctatccagttctaccagagaatcatgtgccggatagttagtcagaagttcaacgccggatggtacttgatgagcatactccgctacactctcgtcaagaagctcggtaagattaacccagtccggacgcaattccagataaccggattctattttagaaagatcaattacatcattaatcagatttaataatagtttgttgttatgtccaatcagagaattatatagttccttttccgctgcattttccgtactagtcaacaggcttgaaaagccgacaatagcatttaaaggagtacggatttcgtgactcatattagccaggaaagcagactttaaccgatcggatgcttctgctttatcacgtgccttgacaagcatttcttctgtccttttcagttctgtgatatcataattgatgctgataatctcgataatccggtcttgcggggcatatttctttactaacagattgacatgcgtccatgtgtatgtgccatcctccctaaggacacgcatctctttgctaagttgggtggtaagtccatttcgtgcgtcgtccagaaaacgaatcaacaaggcacggtcatcggggtggaaatgccggtatgtgccaaagatgtcggacaacggagtttcatacgcttcacccacatttctgtaccagcttttttgagcatagccgtgtccactcaaaacattgaagtgggcataaccgaccttggcataatcgccgaccagttcaaagaactcctcaaactcctgaatcttattataggctactgttgtttctgtcttatccgcattaatcaatagatagtttattggctgatgctcactattatataatgtagtcactttagtcactaaatcaattgtgccctgtttctgggtattctgataatacgaaccaaccttcgagaagtcataacggaaagtaaagtcggcatcttcatttttcttcagccgttctttcatttctttcgggaaaatagggttctcaaaaatattgatacccaatacatcttccttcttctctatatgaaacatctccaattccttatcgttcaaatccaccaataccccatccatatcgtataattcgataccaataggcaaatacttgaaaatgttagataagagacgctcactgtattgcaaagcttgataagcagatgccatatcaggaccatcttgcacttcggatataccataaatgatttcgtttccgttttcatccgtttcttgaaaacataccttgctacgtacccaaacaggtcctttcaccgtatcaagcaaatacaccacctccggccgttgatacacaccataggaatgaatagttgtagaaagttgttcctctttctgaatacgtttattgaaatcttcaaaactaataattccggtctgatccagacctaataactctactataaagtcagaacattcataattcgcagttgataaattggctttccaccatcccatattagcgttagccatcaactgcgagaaaaaggtaaaatcttgtagtctattcataacgctatttatcattttattatttttcgggcgcaaaaatatagattagcgacatatctaactttcagaaagacacttttttagcatattataagaagattatttgtgattaaactaaaaaatttccgattaaaattttctctaaaagagattatttcaaccggaaattttacaatcgtcaagttccttattttactttttcaaggactgataaacagcttttgccatcactttagccccttcttcattcggatggatcttatccggaaacaattggggcattccgtccattgctgcgtgaagatcgatgacagacaagttatttttcttggcaaccttctttatcatcggaatgatttgtttagagatgatatcatcgttgatattatcaccggtctgataggctttagaaggataacaaagataaatcttcggttgagctggcagcgctttgaaagcatcgaccattgtttgcagatctttcgtgaagtcggccttatatttccagttgaatgatttactgtcattcgtacccaacttgataacaacgatattaggattgaaagccagcgcatcctgataagccttttcattcatataaggatgatcgcccttgttcagcagagtgcgggcactgactccgaagttctttacccaataagcctctcccaacatacggctcaacacggccggataactgtcacgatcacgattcttgatacgtgctccatacgtaatactatttccaatgcaagctacacggatagcatctttatgaggtactttgaaactacggagccaagacgtcagttcgtccaacatttcattcttatagaggaaaccctcgcgaattccccatccatgtccaccggaaggataaatatgaagcactgaaggaacattgttcttgttcagcgccaaataataattaactccgttagcaggcggaacgactttatcatcatcactatatacgataaaagcacgcggtgtatctttcgtcacttgcttttcattagaatactcaagttccaattcagcagaagcatcttttcccaaaaggttgtcgtgagagcccctatgggtataagatttatccatcgtaatcacaggatagaaaagaatctgaaagttcggacgaagttcgggcttggcatgagtggcaatggtagaagccagatgtccaccggcagaagagcccatgataccaatgtcattcgggttcaaattccagacatcggcactgtcacgcaccaatttcattgctgcttcagcatccgaaatgggtaatgtacgatcaccgttcggcatccggtattttagcacaatcaatgcaataccttgtttattgaaatagggcgcccaatcacagccttcgtgttcgaatgccaaatgtgaatatccacctcccggacacgcaaccacagcacgccctgtagccagttctggcgcaggaaggaatacgcgaagtgaaggttgttcaatatcaaaaggtttcggagcattttgcgctaccactcgtgaacctgctaaaaagagaagcagcaagataaaaatagtagaaaatttctgtttcatagtatctatgtactttgattaatgaataattagatgcgcgaagatagtaattttgcgtatctttgcagcccattttgattagaaaaattatatgcaaggaataaagaatctgacacaaggtcctatcaaccgtcaactgtttaatctggcaatgccgatcatggcaacgtcgtttatccaaatggcatatagcctcacagatatggcgtgggtaggacgcctgggaagtgaagccgtagccgccatcggttctgtcggaatcctgacctggatgtccggttctatctccttattaaataaggtaggatctgaagtgagtgtcggacaatccatcggtgcgcaaagccaggaagatgcccgcagcttcgcgtctcataatattacgattgctttgattatttccatttgctggggcggactcctttttatatttgcagaacctatcatacgtatttatgaacttgaggaacatatcacagccaatgccattcaatatctgcggattgtttctaccggattacctttcgttttcctttccgctgccttcaccggaatttataatgcagcaggacgcagcaaagtcccgttctttatcagtggcacagggttgatattgaatatcgttctggacccactctttatattcggtttcggactgggaacaaacggtgcggcgtacgccacctggattgcagaagcaagtgttttcctgattttcgtctatcagttgcgttgcagggatgcgctgctgggcggtttccctttcttcacccggctaaagaaaaagtacacgcggagaatccttaaacttggattacccgtagcgactttaaatacattgtttgccttcgtcaacatgttcctctgccgcaccgcttccgaacagggagggcacatcggcttaatgacgttcaccaccgggggacaaatcgaagcaattacctggaacacctcacagggattctccaccgcactaagtgccttcatcgcccaaaactatgctgccggacgaatcgaacgggtacttaaatcctggtacactaccctatggatgacgggaatcttcggtacactctgtactttgttattcgttttcttcggaaacgaagttttcgccatattcgtgcccgaacaggctgcttatgaagccggaggtgtattccttcgtatcgacggatattcccagctctttatgatgctcgaaatcaccatgcagggagttttctacggcatcggccgcacaataccccctgccattatcagcatcagttgcaactatatgcgtattccgcttgctatcctgtttgtacggatgggtatgggagtggaaggaatctggtgggcagtctgcgtcaccaccgttgccaaaggtttaattcttttgagttggttcattattatcaaaaagaagtgcttaagtattccttcaacgataaaatgataatgttcgttttcctttattaacaaacaaagggattcatccgagttattttaacttaaaaagtacatgcttgccaaataatatgtatctttgcattgttatttataatacgaagcgattcgtataaaaacattatttataaaccaattaaaaaaaacatcaacattatgaacaagatgaaatttatggttctcttcatgagtattgccatgatatttggtagctgtggaagtatgaacaacactggtaaaggtgctgctatcggtggtggttcgggtgctgcactgggtgcaatcctgggaggtgttatcggtaaaggtaaaggtgccgctattggtgctgctatcggtacggcagtaggtgcaggtacgggtgctcttatcggtaagaagatggacaaagcagcagcagaagcaaaacaaattgaaggcgcacaagtagaacagataacagacaacaacggattgcaagccgtgaaagtaacattcgactcgggtattcttttcactaccggtaatgcaaatctaagtgctgctgctaaatctgctttaagcaagtttgccaacaatgtgctcaatcagaaccgggatatggacgtgtctatctacggatacactgacaaccagggctggaaaaacagcactgccgcacaaagccagcagaaaaatctgaacttgtcacaagaacgtgcacagagcgtgtctagttatttgttgagttgtggtgtttccaccaatcagatcaaaagtgtacagggaatgggtgaaagcgatcccgttgcaagcaatgatactgctgccggtcgcgaacaaaaccgtcgtgtagaagtatacatgtacgcaagtgaacaaatgattaaagatgcacaagcagctgctaattaaaaaaattctgcgctatacgcgcaacctgctgattttcttctttgcatccactctgttggcagtgattgtgtatcggtttatgccggtttatgtcactccgttgatggttatccgaagtgttcagcagattttttcaggagataaacccacgtggaagcacacgtgggtttcttttgataagatatctcccaacctgccgatggcggtcatagcctccgaagacaaccgttttgccgaacacaacggattcgatcttgtagaaatcaagaaagcgatgaaagagaacgaaacacgcaaacggaaacgcggagcaagtaccattagtcagcagacagccaagaatgtgttcttatggccgcaatcttcgtgggtacgcaagggactcgaagtctactttacgtttctcatcgaactgttctggtcgaaagaacgaatcatggaagtctatctcaactctatagaaatgggaaatggcatctacggcgcgcaagctaccgcaaaggtcaaattcggaacaacagctgcccagttgacccggggacaatgcgcacttatcgccgctactctgcccaatccgatacggtttaactcggcgaaaccttcgtcatacatattaaaacgacaaaatcagatattacggctgatgaatctggttcctaaatttccatctgaagaaaaagccgtagaaaagaaaaaaagcaaaaacaagaaaggcaagtgataattgaatcataaataaaaagaaaggagcaacgaggatctatccccttgctccttttgcttataagcttgtttgtatgcgttatcctcatttatacaaaatctttcaactcttgttgtaaacgttgacgtgtgaagaatatgcggctcttcactgtacctaatggcaatcctaatttctctgcaatctcacggtatttgaaacctgatacgtgcatggagaaaggaatcttatactcccgggggagtgcgttgacgatgcgatgcatctctttcaagtcgtaagcaccttcggtactttcaaatcctgaatcttgtggcagatttaagtgataataattatcggtggtatcaacaaaggtctgatcgcgtactattttacggtagttattaataaagatgttacgcatgattgtgtacatccatcctttgaaatttgtgtccggaacatatttctcttcattgtctaatgcttttaaagatgtttcctgcaataaatcatttgcttcttcacggttggccgttaatttataagcaaaacgaagcaactcttcctgtactccaattaaatcttttctgaaacttaaacttttcatactttaatggttttatggttaatattcgttttttctcgacatttgcaagtttaaaggtattttgtgtatccagcaggggaaaatttgtcatttcttgggggttaattctatcaaatgacagattttaggtgctttctgatagtttttaggtggtatttgcgaaatttatcccctactgcttggttaaaagaaccaaatagattacttttgattttatattattaaataaaacaaaaagctatgaccatacttattattgtagggattattgtattactgggcatcatctttgcttccatgtacaactcattagtgaaattgagaaacaatcgtgaaaatgcgttcgccgacatcgatgtacagttgaaacaacgccatgatctcattccccaactggtagacaccgtgaaaggatatgccgcacatgaaaaggaaacgctcgatcgagtgattcaggcacgtaacggtgcagttggcgcaaaaacgattgatgataagatagctgccgaaaaccagttaagctctgctcttgctggattgaagattactctcgaggcttatcccgatctgaaagctaatcagaatttcctgcaattacaggaagaaatttctgacgtagagaataaactggctgctgttcgccgctacttcaactcggccactaaagaatacaataacgccgtgcagacattcccgtcaaatatcgtagcaggaatgaccggattccaaagagagataatgttcgacttggggaaaaacgaacgtgcgaatttggagcaggcacccaaaattagtttctaaaacctttatatacaccgtccatccaattacaaaagtcgaacacgcatgcaatacgtcggaatccaaacacagcagagccggaataatctgcgctctgcgtttctactattcctgtttccctgtctcgtggcagcactcctctatttggcctgctacctgctgacttttatgggatataaagaggatatggaagtcgaaatgatgccaatagtcaatcatttcttcttctcttcgttaccatataccatggggattgtattaatctggtttctgattgcctattgggctaacacaagcattatcaattccgccaccggctccaagccgctgaaccgtcaggagaataaacgagtttataatctggtggaaaacctctgtatgtctcaaggcatgaaaatgccgaaaatcaatatcatctatgacagttccctgaatgcatttgccagcggtatcaacgaacgcacatacaccgttactctctcggagggcatcatccggaaactaaatgatgaggaactggaagcagtcatcgcgcacgagctaagtcacatccgcaaccgcgatgtacgcctgctgattatttccattgtttttgtcggtatcttctccatgctgacagaaatcacgttttatgccattacacacatacgcgtgcgtagtaatagtaaaggtagcggcggtgtggttctttttattcttattgctttagtgatagccgccatcggttatctttttgcaagcctgatgcgttttgccatctcacgcaaacgcgaatatatggcagatgcaggttcggcagaaatgacgaagaatccgttggcactggccaacgctctccgcaaaatatcagcagatcccgctatcgaagcagtagaaaggaaagacgtggcacaattatttattcagaacccccaaaaggcatctaaaagtatattcagcggacttagcggattgtttgccactcatcctcccatcgaaaaacgaatcgaaatactggaacagttctaaatcgggctaaactcataaataacagggggttctgtttaattttcattaaaagaaacagaagtatccctgtctttttagtatatttgattgttatacatatatacatcaacctaaatgcaaactgatatgagaacgaagaagcaaatctttatgctgttactagccttgctagtgggcatccctaccctttcggctcaacaaagtaaaaaggaaaagaaggaacagaagaaagaagcagtaatgaaactaattgaatctgaaaattataagatagatgtcaacactgccatgccgatgcgcggacgctccatccctttgacatcttcctactcactgacaatcagaaatgattcggttatttcttacttgccttattatggacgggcctatagcatcccgtatggcggaggtgacggacttaacttcaaagccatcctcaaagaatataatgtggaaatggataaaaaagggaatgccgttatcaagttcgtcgcacgtaatcctgaagacagatatgaattcagagccaaagtatttcccaatggttcggcaagtattgatgtcaatatgcaaaaccggcagtccattagttttcagggagaactggatataaaagaggaaaaataatgccgtccttattcttccggctcttcactaccttttaatataggtaggcaaatgtgatatttgacagctaagatgcgggtcaggaataccgccagtccgccaatcaactgacaggcgtatgattccagacctgcaacgtcgcacagccagtatgcaataccgcctacaacgcaggccattgcataaatttcttttcggaagataagaggtatttcattgataaatacgtcacgaatcactccaccggctgctcctgtaatgctacccatgataatagccacccagaaaggataacctaaagcaatgctcttgcctacacctaccacggtaaacaatgccaagccaatggtatcgaaaataaagaaagtattattgagccggatgagccaacgtccgaaacagattacccacagcaaagccagtcccgtacaaatcagatagatagggtcagtcatccatcccggtgtcacgtcaagcaggacatcacggatggtaccgccaccgatagccgtagcaagtcctaccacataagcaccgaaccagtcgaaacgtttcgccgaagctagccggataccactaatagcaaaggcaaatgtgcctataaaatcaagaatttgaacgaatgtgggcatatatttgttattttgtatgcaaagtaacgaataaattccgtaagaaaatgtacttttgcttcacgaattaaaccgaataagatagaaacaatatgaaaataacaattgttgcgggggcacgccccaattttatgaagatagctcccattacacgcgctattgaagccgcacgggcgctgggtaaaagtatctcttaccgactggtatatacaggaaggaaagacgatacaagtctggatgcttctctcttttcggacctcgacatgaaagctcctgatgtttatctgggagtggaaagtagtaatccaacgagtttgacagccggaatcatggtagccttcgaacaggagctgacggagaatccggcacacgtagtccttgtggtagacgacttgaccgcaaccatgagttgtgccatcgttgccaagaaacaaggtatcaaggtagcacatctcgtagccggaacccgttctttcgatatgaaaatgccaaaagaagtcaaccgcatgattacagacggactatccgactatctgttcacagccggcatggttgccaaccgtaacctgaaccagacgggaacagaaagcgaaaacgtatattatgtaggcaacattctgattgatgccatccgctacaaccggaaccgtttgctcaaacctatatggttttccgtattggggctgcaagagggaaattatctcttgctcaccctcaaccgtcgcgtattgctaaacaacaaagagaatctgcgtcagttgctgaaaacaatcattgaaaaatctgccggtatgcctatcgtagcaccgctgcacacatacgtacgaaatgccatcaaagaattaggcatcgaagctccgaacctccacataatgcctccgcagaattacctgttcttcggttatctgataaacaaggcaaaaggaatcataacagattcaggaaacgtagccgaagaagcgaccttcctgggtattccttgtatcacgctcaacacgtatgccgaacatccggaaacgtggcgcatgggaaccaacgaacttgtcggagaagatcctgctctgcttgccaaaacaatggatacactgatgcacggtgaatggaaacgtggcgaacttcccgaacgttgggacggacgtaccgcagagcgtattgtacagatacttacgagcaaataacatttacccggcatgttccattccgtttcccggcatgggactgttagtttcacgccttgaaactaatagtttctcggtgtgaaacaaagtgttttttcaagatgcgcaaatatagtgcaaacctattaaaattcaaatagttataaaactaatgttttaatcggatgtggtgaataaagctaaatagagcatatttgggagtgagttatgttacttatctgttacctcttccaatttgcctactaatcggatataaggcattagttttcaatatattgcattattcttcataacttcaaatacctcaacagtaattaaatttgtaactaaaaaagttgagttatgagaagtacattcagagtgttgttttacactaaaaatcaatcgattaagaatggtaaagtacctgtaatgggacgtattaccatcaacaagaccacagcttgctttagctgtaagaaggaggtgtctatttctttatgggacgccaaagctaatagggctaaagggaaatccgaagaagctagaatgttaaaccaggaacttgataatgccaaagcccaaattgccaagcattaccaatacatatgcgatcatgacagttttgtcacagccaagaaagtctatagccgctatgtcggttttaaagaagattcccacacccttatggagcttttcagggaacagcttgagtcatacaaggagaaagtaggcaaggaaaaggcaaaaagcacctatcttggtttagtagccgattataagagcgcattgctttttttgaaagacaaaaagaatgttgaggacattgcacttgatgaacttgacaaagattttattgaagactattataattggatgttgggcacatgcggctcggccagttctacagcattcggacgtgttaataccatgaaatggctaatgcatatcgctcaagagaaaggtttaataaaagttcatcccttcacgggttttggatgtaagccgggatataaaagacgttcatttctctctgaagaagaactgcagaggcttatacatgtagaattgaggtataaacgtcagcaggctatgcgtgacatgctacttttcatgtgcttcacaggcctcgccttcgcagatctgaaagcaattacttataagaatatccatacagattctgatggtggcacatggctcatgggaaaccgtataaaaacaggcgtagcatacgtcgtgaaattattacctatagcaattgaacttgtagaaaagtataagggtgataacaaaaagaaagattctcctgattgcgttttccccgtcggtgattatgaaaccatgaaaagtagttttaaggttttagggaaaaagtgtgattgtaatgtaaatatcacccctcatatcgggagacatacctttgcagttttggctatattgaaaggcatgccgttagaaactttgcaaaaagtattaggacacaaatcgattctttccacacaagtctatgctgaactgatcaatccgaaggttggggaagatacggataggatgtgcgacaagattggttccgtgtatcgcttggccaattagaataagtatgaaaaaacacccttcagcaaatgttgaagggtgtttttcgtattcaggcaggttgcttatttcaagtaacgcctgaaatctttatagttcttttttagtacctcgtatagcccgctttccggatagagcagtttacccccgacagaggtaattgaggtataaggtattgccttttcatcccgtagtgtttgtaatgtacgcttggaaacatgaagcatccggcatacctcatctccactcagataatgttcgtctgcaatcgtcggacgtatccgtgccgcagcagcctccagattttttcctgtccgtttgatccatccggtaagttccttgaactcttccgaatctttagtgataatgtctgccatactctttattttctttttttgattagtccttcctccagaatttgctggatgtccacttctttataaaagaattttccaccgatattagaataaggaatcagcccgttatcccggtaagtctgcagtgcccttttggaaatattgagagccaggcacacatcctgcgcatccagtcacttgtccggtgttacgggggctattttcttttgaaagtccatcatttgcacggacagcatacttagttgtttcttcaagtcctgataagcacttgtttcgataattgtcagttccatgatttataaattaaattgtgaataatgaaattgggtgcaagataaagggaatattactataaatcaatcgtttagtttccagtgtcgttaatagtcattaatagtcattttttgtcagcgtagcttttcttatactttttatttaacgggggagtcgtgaaatccgacatcccttatacaaatggtaactctttcatcttttttccttttttgccctgccacatttctttatgatatggatttcttcggagaaatcagaaatatgagtatctttggaacgaaatatagatttaaatggcaggcaatagccttccaattagatatagacataacattcgcagaatgtctcaagacggaaatctggtaaatttcaatgaatagaggctttttgtgtattgcttatgctatgctttgtcatagcgtggcttacacagctactattcataggtttaccagaacctccgtcttggagttgggtaaggccacgctttctcaaatacttctgccgaataatatttataggttaaatattatacttatggcaaaactccaattacttgcaatcactactcttgacggatacctcttcgacaggactgtttcttcccctttgtgggataatccgaacaaatatggcctcaccaaaatacgggaacgtgctacacagactctcgggccggatgtatctttcatctcattgacacaatggaaaaagaaaaatgaaggtatttatttcatagaagcggctccggatacaatttccgttataagcagcatgttcagatactggttggtggatgaaatcatcctttttgtcgcaccgtatatccaaggggacggcatacgtctgtttacagaaattcccggtccttcctcatgggaaatgaccgggaacaaatgtttcagatccggtatttgcaggctggcctacaaacggattgaataacctgcaattatcttcttatcctgactgacttggtttagacaggcatcttatatttctcccaatattttcttgccttgtccggtcctatccagttccgttggtcatcgattcccctgtccgagagttgtttcctgaccagcttctggatatcaatctcccctttggctatcttgatcagcagttcggaagcaatcgtattcagcattaagtccggattcagttcatccggtatctcttccatttcttttttcataagtcgcttctttattttttaggtttattatccttgaaagtcatctcaatcctgtaattgtcatccagctcgagtgatgcctcatacttctttcctttcttgctggtaaacttcagatatccggtacgtttccccgatagcagcaggagcatctgattatccgtcagttccctgccgttgaacgttctaaataacaggaacccacaattgggatcgctgcatttggcgaccttgttaaagacgataatcgtttctgctccgcatttggggcagttacaatgtggcaagtccggatggttaagtttcagggcaagcagttccgaggtgatttgttgggtataggaattgatgctctgagtaaatgtttccgtggaaactttgccggtttcgatttcatgcaaggcgcattcccaccctccggtcatgctcacgttggcgatcatcttctcttttacaatatcatatacttccagtcctttgggagtgggaatcagtgaccgtccgtttctttccacgtagtgtctggcaatgagcagttcgatgattccggcacgtgtagccggtgtacccaagccggaatcctccattgcctctttttccttttcatcgtccaatgttctgccacaaccttccatcgcagcaagcaggcttgcctcagtgaatatgggctgcggtttggttttcttgaccaatgtatcaataccgagcacgggcaatatttcgtcttcctgaaattcgggcagaagacttccttcttctttctcactgggttcgttatagatgcctctccaccccggaactttgatttggcttccttttatcccgaaaagaacgccgttacagtccgcttgtacggataccgtttctttcaggcatttgccggagaaagcctccaacatgcgtcccgcgatcatggaatagatattctgctcgtcaagggaaagcctctggggatagttctccgtaatgattaacgcatgatggtccgtcatcttgctatcgtccacacagtgccggtttaaaggctggttacagaggttttccgcatgccatgtgaaacggggatgttgcttaagcaggccgatgagggaagggacttgttcgaagatgtcttctgtgatatagctacatccggtacggggatacgaaatgtagcctccttcatataatttttgagcaatgttcagcgtctgttctgcggtcagtccgagtttggtattggcacttcgttgcagggcggtcaggtcataaagtagcggagcttcttctggaacctctttcttctccacttgcaccactttggctgtcgtctcttcatacacttttttacggtccacatcgagtttttccggtgtatcatatttcccggtacaggttaagacgagttctttccctgctttcgttgtccgtagctgtagcagataatagggtttggctataaaatccctgttgtccagatatcgacggcaaatcatgccaagtgccggtgtctgtactcttcccagagaatagttactcttgcctgcagccatgctcaaagacaggctggcattcataccgacgacccaatctgattctctcctggctttagcggcacggtacaggttgtcaaactccttacttgatttgaggctatcaaatccttcccgtatcgatttttctgtcatggaagatatccacaagcgtttggtttccttatgatatcccagatattcaagcacatatctcataattaactctccttcccgccctgcatcagtacaggatatcacttgatcagcctgacccaacagtttacggattacttccaattgtttcagagccgtcggatcagccttgtatccatcttcggttttaatctgacggacaaccagtttgaacgggtcgggaataataggcagcatctccttttccacatggacaatgccgtagtcttgaggcagggccaatgccaacagatggccgtaagttcatgtgacggcatatccgttcccactcaagtatccttcctgtttctccgttacgcccaggacccgggcaatgctgcgtgccaccgagggcttctcacaaatacaaattgttttcatgttactttcttttttaatatgaatgactatttaatttttacactcttgacctttgatttttctttccgtacccttttcttcggttctttgggaatggagagcttctctttcttttccgatacttgtatgctttccgtcagattcggcaggggtatttcctttgccggaaaacggctgattaaatccattgagattcctgacattcccgcattcagtttcacctgatctgccggttggaggtatttctccccgttctttccggttgccagttcgtacatgactgtttcacggccctggaggattccttcgtaattttggtaaggaaggtttgattcagacagtccgttctgctgaagcatcccacaaatctcatcgggtggcaatcctccgaacttccggtcaaaaggagaagaaagaatgtacttgtatgttgccagaagctgcttttcatggctcatatcgggacatccttcatattcctgcagttgtttgattttcttttcaatgctgttcagagctttgaaagtatgtctgtccttattctgaataggcatactacccattcggaccagttccatctggatacggttcaggctggacgtttcccatttattcaacagattactgcgattgctccggtaatcatcccggaggatagcgattggatttttggtacgaaagaataatccgatccgttttccccatgagggttcgtggaggttggacgcgctccagcggatcgtgttgaaacggtaagtatccatgaatctcctgaaatgattccggctggtaaacaggtttctgaaagtttgcaggaatgctttccttccggcagccctgcggctacgtggtatctctttttcgggaatgaatgtattatttatcagttccatatgcattataatttgggcttcgcctgctttttaacggaagcggtttttgtcttgacctttttcttttcattgccacaggacagtccgggcttgtcttgcggtttttcggctgtttgagcttctcctttcttagaaacaacaacaggcgggcttacccgatgatagttcttccggactccatccctgtttaacagtgtttgcgccaatgacctggcagcattttgtaattcatccatcttctgccggaaaggataatcccggtacaattccttttgccgggtaatctcacggatacctttctccacaaacaagaaatcctttttataggcaaacgattcgtctgccggtaaatgggcgtatcctctggctgctatgtcctgaagtgtcataatgttccggttacggatagagagttccaatgcgccggctgtgacaaaccggttgagattttctcccgtaggatgcatgtcgaaagtgacggacggcttgtaattcgccagaatttccatcccggcctgcggcatggtggtctgattcccgttggagagttccagcatccggcgggagacggtttctatccggtaaatattcaatgactccacatcctgcaaagagcttgagtagaaattgtccgctgtcgattgcaggtaatcccgaaactttatagtcccggaaagtccgtcattgaatacgcggacaccttgttccgtttcagctatggtgtagaactgtttggcttgctttcctgccgcaatcttctccatcgcatcttcgtgtgcaataaagcacttataagctggtgagtagtccagatcccggatattctctgccgtcagttccctttggcatgctctcaaataagccgctttccgtaaaggtacggagttgttttcagtgatgcctccgtaagaggcgatgaaactgagggctttctcactgtctttcgccggtagttcgctggtgaaaggaatatctttagcaggtattccctcaaaatgcagcaataagttatccggtatggttttctgatccatagcaatccgggcggtcagatccataaatacctgaaaagagtccttatccgtcggaacatacgacacgaccatgacagtcgagacttgattatccggctgtaacacaataaacaggctctttaaatccgctttagcggtgaatgtatcttttattttttccatccatgcaggcatgataatcagttttagatgcggggattatgtgacttgttctgacgggaagccgtctttctcttttccgaagccgccggtccggtcagttgcaacggaggacaggtcagtctgtatctcaggccaagtatcttgtccgcgagttgctgctgcctgttttgaatattgtagaatgccttttcactatatccctttttggattgcagttcggacatttcttgatccagcggtttaaaatttcctttgtgggtgaactccttatagctttcattagtattgaaatcagccggtaatccgtattcccgtataaagagcagggtgaatatctcggcattctccggcgttaccgaaagccggtaatcttccgtaaactgtttgaatgcatggtatgtcggctctatgggatagccgcctttcttcaacagctcggattgctctatcggatacaatggcattttcgccagctgcccgtagaaaggattggaccggaaaaggtccagatgcttctgcatgtaatgctccgtgctatggttcgggcaggaaatatagaattctctgattcgtcccagagcctgtacttccggagtgaagaaacggtcagccagatattgcaggtaacactgtttatagatggctccttcatccgtggcgggcaggtagacggctcctttgggagtctggagggaaatgatggggtctatctctttgttttgcaggctgtccgggataagcccgtaatcacgtttcaggatataggccgcctgatcccggatctgtgatttgaccttctcctgtccgcctttattttcagccggaatattctgcagcgcattgaactgggagttgaaagaattcttgtgtatgaacggaatccttctggttgtatagtctatcccatagattcctgcggtttcctgtaaggatagtaaccggagtatctgggcattggcaatactggggagcacgttataggaggaagcaaacttgtcataggcatcgaatgtcggttctatgcggtggctcctgtccagccgggcattccgcaggatagtcgcatccagatattgtgctttctccggcagaaaagagtttgtatataaggagaaggcattgggagatgcttggaatgcctttaccacttctgcgtccggacgggtcagcttgtacaggttgacaaactccggtttctcttcgtccgtaatgaagaaacggtcggccagatgttgcatataggcatggcagcatgtctttccaaagccggaatattcgaacagaagcactcctttggcggtttccacggcggtcagggtttccgacggatcgtcgtggagagtatcctgtgccagcgcgaaccgtttggcttccggctgtacaagcaggtggtcggcaagtccgctggctaccagcatgggcaggcttttttcttcatcgtgagaatgcaggtattccagtccgcgcaatgagacattgccctgcatgcttcctccgttccgggtgatgaatttttgtaccaagctgttatccttgtcaaagagccggatatccgggtagcttactcctgccggaaactggtagcggcacagataaagatccggcaagtggctttggacaagggacggcttgtacatttccctttgccgctggaggtattcggtgaatcgttgattcatcatcgatacttctttctccggcatcaggtgcatctccagttgtcggggttgcccttccaagtcctgggtaacaaagaaaatcataatgtttgaaatctcttgcttttgcatacgattgaaatttaaaatagttacatggtgatacttctactctttttcttttcctgtttgggcggttcatagccccgtaccgcatagtccgtctgtaggattctctttgccgtatccttgatggtccgttcaagtgcatttttcagcagtgtgccatcctgcttccccacataagacagcctgatccgttcatccagggagacaaagctgttttgatggttgaaccggctgtctttttccaaattcccgatttgcccggtcttgcagatccggtcgagtacgcctatgttataattcttctggctcttgcccagattcaacttttcggccagttggttataacattccaaagagggagccatgctgcattctaccgccggggtatagttggctatcatatttgaatccaggaaatgagccttttggggaaggtatatcttttttaagccatgttcaaacatgttcgaacactttgacgcctctttgatcagattgatattggaagtgctgaaataatatatttgcagtttatccgcatccctgtaaaccggcgagaagaaattatcgccaatatgctgcaggtatttctgcgcacactgtatccccctgccggtatcattgaacatcaggactccctggttcgtatttattgcagtaatcaccctgttgtagatatctttttccttttcttgatggaatgcgcggtaagcgttcagttgttttttcagcaggggattgtctttggccttttgaagcattctctggatgctatccacattatggatgccataaggagatgtattctcgtaaacgaaggcgatatcccgcaatgggaaatgagttgcacaagacagtcctccgttatgggtcatgtccttgatgaacctttcaatgttccccggttgtacagcaccctgatatggtattaaatagacttcttccttaggaatgtaggagcctttcaaggccagttctgcctgcccgaaaagaaatttgccgccatctgaattgatgccataacgattctctatggtctggaaatgttcaatctgcctgttgctgttcaaattgaaaccaatgtatgtactcatattattttatggtttagatgaatggttgattaagatagtctatgccgtttcgacgggtcgggaacttttttattcttcattttctgctccattttctgtttttcttccaggtctatagtccatggaaaacaggtcatgatcttgtccgggcagcaaagggagattcttttttgtttcatggactcatcatccagccggatatagacaaagtaatccagttccccttttccggtttcttcaatggctgttactgttcctttatagggaacaacgggagtttcctcttccggatcgttctctacaatccgcgctccgaggtacatctgacttttaggtatcatatcgctttattttaaacggttattgttatgtctgttcttattctcagtctttttaacggtattcttctcttccggcagcggacagagcagtccgtcctttatcacgtatgtcctgacgccgaagggcttggaggaaccctcaattctgccctgctcaaagtcggccttgcaaaaaaggagatgccttgtcgcctccttgttgttttccgggagatacagtgcgtatcccgaagccagtgccgtcttttgaacttcattcagttttcggcttccgacggtgaaggtaacggtggagtcattcaacatattctcaagggaacggtgccctctcacatcgaaatcccttttcaaaattccatcggcagccttccggatttccgtagacaaccgcttgaactttcccgtatcgaattcgccggcagatttaacctgcgtgactttttcaaattccttggcatacggcagcagttcattgaaataggtaaacggttgttcatgaatattcatataaccgttacgcatgacggtcagcagccggtaaatgtcatggttctcccggctgatggaaacctgcgtatccttattgaaatgccagtcggtggcgaattttataaaatccccggctgtcgcttccatcgaatggtagcataccggttttaaactgtcgatgaattctttgggcagttcgtcaagaccgatataggatgccggataaaaatcgaaggaataatccagttccatcggtttgcacggcttgtaagcggcatctatgagaggaaccaggttcttgtccatgaacgtactgtcgtagacggccagatggccggtatcgtagtgcgggtcgaagtaatggtccgtgatgtaccggatgcactccctgaatccgttcctgccgatctcgttaccggaaaagataaggtatccgaagtcattctccaccacttttaaggggaatgtgtaccgcggctggcaccggtacaatgtccttttttcctgttgctgtaatcgaaactccaagtatgcgggttcctgcatgagatacttcttcaatatgccgccgtccggttcattcttgtatttataggtatagaccgcatcacgcagggaaatgcgtttggcagggggaatgcagtgttcttgaaaatacggcagcagttccttgctgatatattcctcgaaaggggtatgggtatctaccggtggaacctgcctcatgttcgccaggtcaaaccggagcagttccgtatccggaatataggggcagcactccgcttccttgatattgtcaatcaggaatttgcggaacaggctgtccgcatctcctttctgaatgaatgtgagggcatttcggggctggtggggagagtactgatggtaacggtccataccgacaaaaatacttcccggcttgtcgggatcgaaaaaaggattttccatttggtttctcttgtccatatttctacaatttagggtgggtatttcttttctttttcacgtcctgctttttattcaaagccttttcgatgactgttttcactttgaacacctgtttgttcgcaggaggatccttagaaaatacgatccgggtgaaatccccgtttatccatgcataggcatgggacgggttgctttttgcctctcccggcaggaagagtccgtgccctgccgccaatacttgccggtgaggggtaaagagccggacaccgtctacggtgacacattccatcgggtcgcggaggatgttcccaacagtccggtgtccacgcacatcgtaatactgcttgaggagtttgtccagcaaggctttatcctggccggtttcttctatctgctgccggatatccgatgctgtaccttgtttggaaagctccagtaatttacggtccttgctttctatttcctccaaaatatcagcgatattacggttgcgatggctgctggtacaatgcatattgtggcagaaactaccgaaatcctcccaggtcggcttcatctcattccggtagaccagctccatttccggtgtcttatccatctgcaggtaagcatattccgggtacaggccttcacccggattgacataggatccatcctttaggactccttctgcccggtaaacatttaccggaccaagattgaaatggggatcgaagtaatggtctgccataaattgcagaaagtcctgcctgtttttctgtccttccgtcgtatcagtaaagaacacaaagccatgggctgtctctatggctgtataggattgttcaggttgcttcatatcattacattttgagggaattgttccttttcgttttcgatacctttttcaaagccggtacatatggaatgattttgccgtttttctcctgatacacggtcttgtttacgggagatttggtatatgccattacccggttgcatgtcttttcggcatggaggaaatgtaaatctggcattgacttggatatttggggacagtagatccactttccttccagcaaggcttgcctcatggcttcgccggcatcggttccattgatgagaaacgggacgctcctgtcattcagtgtcctttccaatgtacggtgtccacggacatcgaaatccgtcagaaggatattcttcgctttccaacgcatgtcatccagcacatctgacaaatctggccccgaggactgtccgttgatacagtcgtctatccgggtgacatactcctgaaagacattccggtatccgaaatcgggatcatttattatatcccgcttgaatccgttctccatcagatacaacagtttgctgatatccgcattgttacggctcgcaggacatccggcaaattcattcaggcggagaaattcagaagcgctcggctccatgtccgtttcaaacgccagtttccactgtttcctgtcacggaaagcctcttttgagaatacagcattatcaaaatcatattccccttttccgctttggggattcttccggtagcaggcatccaccaaaggacagatatcgtcggacaggcagttgacgttgtattgcctgacaggaccgggttcgccatgaacccagaaataattgccggataactgttggtaaaagctcttcaatccctcccgtcccattttggtatcactgaaaaacaagattcctttggacgtttccacagcatgcagcggtaatttgtaaaccggattataatcatacctggcagccagctcatcctgcttctgatgaaaatggaccagctcgtccaactgctgtgtggtcagtttcggaagttctcccgatatcatgaggatatcgctgcgtgactgcgcaaacaggacatttctcagattggtacttattagaggagccagtcccttttcccggatatagggtagtaatacctgattgatatattcctttttggaaatatctccggagatagccggtacatccgtcatcttcgggaatgaatagatttccagacgggtattcggtacgaaggcggagtatttggcttttatcgattgttggctgaacaaggccataaacgtatagacagggtcttgcctgtcgggattggcaggataaagcatataggaggattctgcatggggtttctccttgccggtttcataaccgacaaggagctggccttcaccgtctttcctgaaaagctcgtccaatagtttgggatcatcagaaatataggttgccatttttcttacattttaggtgtgatggacggtttacgggtacgcggtttcttttccgcttgctgtgaggcttcctcttttttccggggttttccggctacttgtaccggtgcatggggctgctgctggcttccgtcttgttcctgaccttgtttctgtgcctcttccaacttcttggtgcttctttcccagaggaattccacccctcgctcggcggcactcatctggatggaggtggcataaaattttccattatcagacttgaaacggatcggtacttcctcaccgcgcacggcagcatcgtattctttcggagaaagcgtataatctttcaccttacgcggaatgcgtgcctgctctacgggcatatggaacaattcattggtcaccgggtctttggaaaggtagcaggatttggtttctttggtacggtagtcaatgactacatccaccgccttgccgagattgccggtctggttcagggccttgaggtcttcttccgtcaggacatgtcccctgtagtcttccccgatcttgggagcctgacggatgtagtggatgtcgaacttgacagctccgttctcgtcgcggaacagggagagtttggcatccccgttttcacgccccagctcggaattttttgccacacggaaagcgatagcggaagtctttccctgcaacattctttcgaggctgtcctttgcgttcttcagtccgtccggggtaatgccgtatttggcggcctgttcccaattcacttcccgctcgttgaagcgatggttattatacaccctggtcgaagccagttcccttctgactgcttcgttctgtggttcctgcgccgcttcgatcttttctttggcctgctctacgagcgtttccttcggcatgttgtagagggagtaacgaccgggattattgtactggtagagaaaattcttcccgaagttggtgaagaagtttccacgttggtccactttgataaactggtccctgttcgcctcgttagcttcgagcgtttccagctctccgttcgctgcgattccttttacacctttggctttctgctctttcttgtcatacgccatcaaatacccgtgttccggggttgcttccttgttttcaggagctaaattcacatcgttcatatacgttaattttaaagattaatgaatcatttacgagggtaaaattactatctttgtcattaaatagtttgattatgaggaagttgtcattaattgtcatgttctgtcacttattgtcatgtccggcttttgcacagtccccgtcaaagggatataaagccggactcagtgctgtcatctaccgtatccactctgcccggcagtgaaagtctttcatatgagacagccggttgccggttaccgtactggccgattatcctattctgtatccattgaatgaaagtcggaggaggtatgccgtttcttccggtttcggtataaggatgcatccggtgaaaaagaaaaggatactccatgccggagtggatcttgccgcaccctatggcacgccggtctatgcttcaggaagcgggaaagtcgttgaagccaggtatagcagcagttacggctggtacatcgaaatccggcacgcgggcggcttttccacgttgtatgcacacttgagcaaattgcatgtgaggaaagggagcgatgtacgcataggtcggcatatcggcaatgtcggtcataccggcatagcgaccggcaaccatctgcattttgaactgagaaaaaacgggaagccgcagaatccgttgcagtgggtgatactaaaggattcccgttctaaaaagagtcattaatttaatccgttacacaatgaacattgaagaagccaagagcattcagttggaggattatctccggcgtatggggttcaacccggtaaaacaacaaggggacagtatctggtattgttcccctttccgtgaggagaagacaccttctttcaaggtgagcgcatcccgcaacctatgatacgatttcggcatcggacagggaggggacatcatcaccctggcgatggagcttcaaaagacgaaggatatctcttatgcgcttaaaacgatagagggacattttccggctgctttccgtccggtagcagcctctccccggcaggcggaaccgcaggctaccggctaccggcaggtacgcattgatccgctgacgaacccggtcttgctgggatatctcaaagaaagaggcatcttgcctgaaatcgcaagggaagcatgcaaggaagtgcattttcagaacaagggaaaatggtattttgccgtaggctttgccaaccggagcggcgggtacgagatccgtaacaaatacctaaaaggcagcatatcgcccaaagagattacccatatcaaaaatggcagcgaccgttgcatagtggttgaaggctttatggattatctctcatacctcacgctcaaggctacgcatcccggtaacggacagcctaaaggaaacggtccggactatatcgttttaaattcggtcagcaatgtaggcaaggctatccctgtcttgaaagagtataagagtgccctctgcctactggataacgattccgccggaaggcaggcttttcagcagatggcgcaagccggatgcccggtcagggacaagtccgactgctaccgggagtataacgatttgaacgattacctgttgggcaggaagatggcgcaggagaacaagacggatcatcagcacgaaacagccccgaagctgattgaaaagcctgcaaagaaacagtccggttgaaaattataaaatactggtccttgtctgatgcatgaaaggcaggcaataaaaaagagagtcaaatccctgctggagggaatttggctctctttttattgctacccggctaccaccggatatttattcttaataatttctgatcagcaattcattgaccgcttctcttttctcggctatggaacagatggaacggaagatgctgattcgctggatatggaaaccggcatagaggtcgtcgaagaaggtgttctcagggttcttttgccggggatcggagttggaaagcattcatttggcaccggtttcacctattcccttgcagaaatttaccagatttacgcattatatgtatagaatgaaaacaacatccaataaattgataacaaatatactgtaaatcaaagttttataatcttatttttattttcggttgttttcagtactttcagtagattggctcttgtttggtgcaattttgtttctcatttgtttctcaaattcgatacttattcgtatatttgcagtagaaaaaatgagaaaggaatccctatggcacgagttaagaatcatacaaaagtcaaagagccaattcgtcttcggatgaagtcgctgagcaatggcagcaagagcctgtatctggatatataccgcgacggaaagcggacatatgaatacctcaagatgtatattatcccggaaacggatagcaactcccgcaggcagaatcagacgacaatggacgccgccaatgccatcaagtcgaagcgtattatcgaactgaccagtaatgaggccgggattgtattccgtaaggacaagactttcctgctggattggatgcaggtttatatggaggctcaagagagtgccggtaagaaagatggcagtcaaatcaagattgccatgcgcatactgaaagactatgccggagaaatggtcacactggatcagattgacggggacttttgtcgtggctacatcacttatctgctgacggaatatcatccgaaaggcaaggacatatcgaactacacgcttcacaattattaccgtgcgttgaacggtgcgttgaactctgccgtcaggaagaaaaagatgaaggccaaccctttcaacgaacttgagaagtcggagaaaatccgcaagccggagagtatgcggtcgtacatgaccatcgaagaggtacaggcgttgattgacactcctatgccccacggggaatacgagattgtaaaatgcgcatatctgttctcctgcttttgcggattacgcatcagcgatataatcaagctgaaatggaatgacgtgttcgttgacaggggacagtaccgtttggccgtgtccatgaaaaagaccaaagagcctatttacctgcccctctctcctgaagcgttgaagtggatgccggaacgtgggggcaaatcatcagaagataatgtgttcgacctgccgtccgccaatacaatcagaatgcagctcaaaccttgggcgaaagcagccggaatctccaagcggttctcctaccacaccagtcgccatacgtttgccaccatgatgctgacgctcggagcggacttatatactgtctcgaagctgctcggccatgccgatgtgaaaatgacacaggtgtatgccaagattatcaataagaaaaaggacgaggctgtgaatcttgtaaacggtttgtttcactaattgaaggcattctgtggtccatgtctaatttacaaacatatatttacggcatttctccggttgtaaatgcaaccgaagttaatgcttccatcacatattataaactcaaaaaggtaaatcgacatgaaaagacctgaagacggccttctctctttttggagggagccaacacctgcagcacttcgctgcggacaaggatgtggcgaatgaacttttcgccctgcttaccgaagcaaaaacagtttatctccacgatgttgtgttgggtggtaaacagtaccaccgctatgtggacgatttcgtaaacggacaccggtacatagactgtgaccatgcggcctgccggaactgccacgaaatgaacatccacattgtcaaggggctgctgaccgagtgcgccagttccgtccagccctgctttgccgcaccggatttcacgtttaatgagtgcatgaagttgaaacggatgtatgacacctcggaatcgttgtctccgcttggtccgccccgtatcaaccgacctgcggctctctctctttcttttggttgtaattttaccccggaacagatgaaaagtatagtggcttgcgccaatacttatcatctgttctgtgtttctgtacgcattgaagacatggaggctctcttcgcctgcaagaagggcttttccatccgcgtgaacaatatccgccgtgtggtaatcctgttcgatgcgcttcttgaaaactcgttcatccaatctcggtggcagaatgttctcggcaagggcgcattcctgcagtccaaggacgggacacgctccgtttcggtgtcaaccctgtcttccgcgctgtcatccatcaagaacaacatgacatcggtcgcatacagcatccgaaaggtcattgatcggctgaaagaatgacagaaagtgacaagaagcgaagtatgtgaaaggtaaaagcatgagagttacaatgacacgtgcatagtatcattccccaaatcacggcatcttcgtttacaggacatacctttgacctccgttagcgcgctgcataacggaggtttcatctccattgtcaaaaatcaaactgtgttattatgccgaatagaatgacattcatggagcggatgagcggacggctcgccgccatcgaatcggtactgaagaaattggaaccggtcgaaagtctcttggagcgtattacgctgctggaaaataccatcttcacgaccaagagagttttcacatttcaggaagcctgcatgtatatcggggtttctgaaagtatgctgtacaagctcacatcgagcaaggagataccgcactacaaaccgcgcggtaaaatggtttatttcgccaaggaggaattggacgaatggctgttgcagaattatgaacctaccatgaacgaggcagtgcgcagggtgacggaagccgccgccacagaaccgttccttaacaagagacgctatggaaaacgaaagaaggattgaccgcacaaccagcatggggatggatgaacaccgcctgtcggacatcctccatgcctcgcaaatcaaggcgacggacatttatgagacccctccgcaaatcatctggatagataactcaacgattgccacgctcggcaatttcagtgcatcgactggcaaggcgaaatcgaaaaagacgttcaacgtctctgcgcttgtcgccgcatcattggcggggaaacaagtattgaactaccgtgcacatctgcccgaaggcaaacagcgtattctgtacgtcgatacggaacagagccgtttccattgccgctcggtattggagcgtatattgcggctggccgggttgcccacgacgaccgatccggagaatctcgattttttctgcctgcgtgaatattcgccgtcggtgcgtatcgaggtcatcgactatgcgctgcgccaacagaaaggctacggactggtcatcatcgacggcattcgcgacctgatgctcgacatcaataatgccggtgaatcggtggaagtcatcaaccggatgatggaatggtcttcgagatacgacctgcacatccactgtgtgcttcatttgaacaaaggggacaacaacgtgcgcggacatatcggaacggagatgagcaacaaggcggagaccgtgctggtcatcagcaagagtaacgagaatcccggcatcagcgaagtccatgcgctccatatccgggaaaaagagttcaagccgtttgcatttaccatcaatgaaacaggactgcccgtcattgcggaagtacactcgtttggcgagcccccgaagcccaaggcaagaacggggtttacggaactgagcatcgaacagcaccgcgaagctctctctgccgcattcggggaaaagcccatccggggattcgacaacctgctgcagagcctgatggtctcctacgaggcaatcgggttcaaacgcggccggagtgtcatgataaaactgatgcaatacctgatagacaacctcaagctcatcatcaaacgggacaagttgttctattacgacatgacgcctaccgaggccatgctttttgatgaagaatgaagtcgtgcgcgggcttatatcatttagtatactttagtatttatatatataggggaaaaactaaactaaacctttttttgaaatcaagtgaaagaaaaatagatgaccatagcagaagcaaaacaagtacgcatcgtggattttctggcacagctcggccaccatgcacagcatataaaatcggaacaatactggtacttctcaccgttacggaacgagcgtaccccgtcgttcaaggtgaatgaccgaatcaatgaatggtacgatttcggcgaggcgaccggcggcgacctggtggaactggcaaaatacatttgccggacggactgcgtgagcgaggcactggcgtatatcgagaggcttgtgaatggcgcatcactaccgagaacccgtatgccgaccgctccaccccgaccggtggaggctgaaatgaaagacgtgatcgtgattccactccgccatcacgccctgttctcttacctccaatcccggcttatcgacgcggacatcggccgtatgtattgcaaggaggtgcattatgaactgcgaggccgtcattatttcgctctcgcattcggcaatacctccggtggttacgaggtgcgcaacgcctattacaagggatgcctgaacaacaaggacatctcattgataagacatctgacagaagagacacaggaaaatgtctgtgttttcgagggcttcatggatttcctttcctatatgacactgaaactggcaggcgaccgaacggtctgtcttgccatgccatgcgactacctcgtgatgaactcggtaaacaacttgaaaaagacgctggcacgtttacaggaatattcggtcatccactgttatctcgacaatgaccttgccgggcagagaaccacagagaccattgccgggatgtatgatggacgtgtcagcgatgaatcctgccactatgcggaatacaaagacctgaacgattacctgcgcggaaagaaacgctgatattcagtgttctcctttgccacctaaagctctccaccacgagagctttttttatgccccgatttctccatttccctccatagagactgcaatatagtacgatttaatagttcgatttttggaaattacataaatctcattaacgaaatagatgtttaatgctcaattattttatggttttatatttcgtgcgtttctttgcaaaatcatactaatacaaattttaatattcatactaaatacatgaactcatatttcatttttgccatcgtcctgacggttgcctacatcatttactacgccgtcatcatagcgcatgacatctacgggaaaaaggggacggacaaaccgaacgaggaagttttcgacctcggcgcaccggaagaggaagagagtgtggctgtcacggaaagcgagaccggcttcagtatcggtagcgagaactacgagacggaaagtacggctacctcttccgaaacatcccttgaggatgtcaaggacaaaccgggaacggcgcaggagaaactggaacggctgaaggccgaggcggaggaacagatggaagagaccacgccttacctgtcggacgcacgcacgtcggaggagatgtacaaggctatgatttccaagggacggttagacaaccgaccggaaataaagtggaacccaattcaagaccggttgtgagatgtcgaaagctaaaaagattctatgtgcgctgtgcctcccgttcccctacacgacttttgccaaaagcggcagcgtgaactatagctggggagcggatgcgttggccacgatgcacgacttcgtggtgacgatgatgctctatgtccagtatatctgttgcgctatcgccggagtttacgtcatcgtgtccgtctgtcagatatacatcaagatgaacacgggcgaggacggcatcaccaagtcgataatgacgcttgtaggtgcgtgcctgttcctgatcggggcattctatgttttcccggttttcttcggctaccgcatataaccttacttgtatcaggtcgcagacaaataaagtattcactaaaaaagtaaacgtatgtttcagaaaaccaaacaactgtgccgcaaggcattcggattcgtcaacggaatccctaccaaagtaatgatgttctccttcatgctgctgtccggcatggtggcgaaagcgcagaactccgcaggcgactattccgccggtacgagcgcattatccactgtcgcggaggagattgccaagtatgtgcctattatggtgaaattgtgctacgccattgccggcgttgtggccatcgtgggtgcaatctcggtatatatcgccatgaacaacgaggagcaggacgtcaagaagaagatcatgatggtcgtgggagcctgtatcttcctcattgcggcggccaaggcgttgcctctgttcttcggtattgccgcttaaacatcaaggataagtatgaaaggcaaggacgaacgctatccggactacccgctgttcaagggactgcaacggcctcttgagtttttgggcatccaaggccggtatatatattgggcggcggtgacgacgtgcggagccattgtcggctttgtcgccgcctactgcctgctcggtttcattgccgggcttgtcgtgctggcagccgtcgtatcggccggtatcgtgctcatcctcctcaaacagcggaaaggactgcatagcaagaaggtcgttccgggtgtgtatgtgtatgcccactcgcgcaagatctgacgaaagaaaaaccatcacggcaatgtgcatggctttattgattgttgaacgcgggcgggtttgtcttgaagcaaggcgaacctgcccctatttaattacacgtatatcgaaatgaccctatacatcattttatgttttgtcgctttgtgcgcgggtatggccttgtcggtctatgcgttcggtacgggcggcaagcgcaagcgaatctttcaggacatctatttctcggcggaggaaacggacggtgtgggtgtgctgtacaccaagaccggcgaatattccgccgtacttaagatagagaatccggtacagaaatattcggcggacattgacagttactacgacttcacacacttgttcaccgcccttgcgcagacgttgggcgaagggtacgccatccacaagcaggacatcttcgtcaggaaacagtttgcgagcgaaccgactgacggtcaggagttcctgtcttcatcctattttcgttatttcaagggacgtccttacacggacagcctttgctacctgaccatcacgcaagaggcgaagaaaagccgtctgttctcgttcgatagcaaaaagtggcgcgacttccttgtgaaaatccgtaaagtacacgaccagttacgtgacggcggcgtacaggccagattcctgaacaaagccgaagcgagcgagtacgtcgatcgttacttcgccatgaacttcaaagaccgcaccgtgtcgatgacgaacttcaaggcggacgatgaaaccgtgtcgatgggcgacaaacgctgcaaggtgtacagccttgtggacgtggactgtgccgcactgccctcacagatacgtccgtacacgaatatcgaggtcaacaacacggaaatgcccgtcgatttggtgtcggtggtggacagcatcccgaacgccgagacggtggtctataaccaaatcatcttcctgcccaaccagaagcgtgagctgtcgctgctcgacaaaaagaagaaccgccacgcgagcattcccaatccgaacaaccagatggcggtcgaggacatcaagcgtgtgcaggaagtcatcgcccgtgagagcaagcaactggtatatacacacttcaacatggtggtggccgtgtctgccggtgcagacctgcaaaagtgtacgaaccacttggaaaacgctttcgggcgtatgggtatccatatcagcaagcgggcatacaaccaactggaactgttcgtcggttcgtttccgggcaactgctacacgctcaatgaggaatacgaccgtttcctgaccctttccgatgcggcgatgtgcctgatgtacaaggagcgtgtgctgcacagcgaggaaacgccgctgaagatttactacaccgaccgtcagggcgtgccggtggctatcgacatcacgggaaaagagggaaagaataaactgactgataattccaattttttctgtttggggccttcgggcagcggcaagagttttcatatgaactcggtcgtgcgccagctccatgagcagggaacggatgtggtgatggtcgatacggggaactcatacgagggactgtgcgagtatctgggcggcaagtatatctcctataccgaggaacggcctattacgatgaatccgtttcgcatcaaccgggaggaatacaatatcgagaagatagacttcctcaagaaccttatcctgatgatttggaaagggtcggacagccagattcccgaaatcgagttccgcattgtcgagcagataatcatagactactatgatgcctatttcaacggatttacaagatacaccgacgagcaacgggaggtactgctgaaaaacctgtttgcggcggccagccgaaagaacccaaacaaaccacccagagaggtggatgagatggtgcgcaaacagatagaggtgcttgaggcacggcgggcggctctcaaagtgtcggaactgaacttcaactcattctttgactactcattcgaccgtctggagcagatctgcaccgaaaatgacatcacgacaatcagctactcgacctattcgaccatgctgcagccgttctacaagggaggcgcatatgagaagattctcaatgagaatgtggattcggcactgtttgacgagacattcatcgtctttgaagtggatgcaatcaaggaaaacaagaaactgtttcccattgtcacactgattatcatggacgtgttcctgcagaaaatgcgcatcaagaagacccgtaaagtccttgtcatcgaagaggcgtggaaggccattgccagcccgctcatggcggaatacatcaagttcatgtacaagaccgcccgtaagttttgggcttctgtcggcgtggtgacgcaggagatacaggacatcatcggcagcgaaatcgtgaaggaggccatcatcaacaactcggacgtggtgatgctgcttgaccagagcaagttcaaggaacgctttgacgaaatccgaaagattcttggtctgaccgaggtggattgcaagaagatatttaccatcaaccgcttggagaacaaggatgggcgcagcttcttccgcgaagtgtttatccgtcgggggacgaccagcggcgtgtacggcgtggaagagccgcacgagtgctacatgacctacacgaccgaacgggcggaaaaggaggcactgaagctttacaagaaggaacttcggtgcagccatcaggaagctatcgaggcatattgccgggactgggatgccagcggtatcgggaaggccctgccttttgcacaaaaagtaaacgagacggggcgtgtgctcaacctccgtcccgtgcatgaatccaaataaacattgcagccatgaaacgactactccttatcctgaccatcgcctcggtcacactctgccagacggttcacgcccagtattacagcgtgaactacgacacccgtaccgttgcggcgatggtggctgccttcggtacggaagcggtcgccgaagggtactaccgggagcaggtcgatgacgtcctcaagcactacacggcagcggaggtcgctaccgccgggatattcgcggccaagttcttggagcataaagccctgagcgacctcggcatctggaacagccgtacggaaaactactactaccggcgcatctaccggatggtggcggagaaaatcatgcccaagatatgggtggtggcgaagcagatgctccattcgccgcaaacggctatctattggggcagttacctgatgaaagtctgcgatgataccaaaagtctgtgtatgcagttcgagagcgtggtgaccaacagcacgctgaccttttcggacatcgcctttctcgaaatcaatccggaaattgcccccttgctgaaactctccgaaacgggaaacatcgactggcagcggatgatggacaacttcgcccgcataccgggcaacttcacccacgagaacctgaaaagcgacctcgacaacctttataacacgggggtcggccttgcaacggcaggcattgccaatcttggtgacgccctgttgcaaagcagctcgttccatgacctgctgggtggaaaggttgaagaaatcggcaacctgtatgaacactacgggagtctattcgagcaggcggaacatgacatcagcggcttgctgattgacatggtgggtggtccggacaacgtggccggtctgttcaacttcagcaactacaacctcacggcatggatgaccgactacctggacgaagcgatggggaactattacacgcagcggtggtacattgcccggcgtgaccaagggagcgtatcgctgtgcgactactatcctccgacggacgacaacagcatcctgaacgggggcgcatgggtgcggttcaacacgagcgacccgaatttctatcctgatgcctcgcaacgggaacaggtacttgccaactcggaaggatatgccggttggtcaagaaaccgcgtgcagcagttgaacaaccagaacgacgggttcagctacagcatcaactattggatgagtgcctatatcatcagcaagaaaaacaagcagaccaaaaaggcatacgcatacgaaatccatgtgagcaaaaactggaacaaagaagaggtcgtctatgaggaagtcttcgattcctactcgatggacttgaacacgtttcgggcgcaactgaatgtccggcttgcggagttcaacgagaacgaggacggctacacctattatatatcttccggtgcgcggaactattaccaagcaacggacgcagccaaattgaagggatgcgagagcgtgaccatcagcgtgacctgttccgacggggttacgctcggacaaggctcgacacagtacaagtgccgcaagtgcggcagctcgttgaatgcccacaccaaggagtgcgccatgcagacctcggtgacggaaaacgacctcgacctttcggaactggacgcgctattgaacgaggcgaacagccaagcggccaatattgaagcgcaaatcggggcattggaaaacgagaacgctgtcctgctgaagaaaatcagtacggcgagcattgaggatgcggcgaattaccggcagcagtacaacgcgaacaagacacggatagaccgtctgaaaggagaactcgcggaatggaagaagaaacagtccgactatgcccaagcaaagtcggatgccgcagacgacaacagcgtggcgacggatgactattaccgcatccctgccatcatgcaggactgcaaggcggcatacggtcttacttggcaggacggcggagcatggaacggctactcgtatgtacgcaaggcgaccatgccgaatatcaacggtatcatcacattcagggctacggtctccattgcccgcaagccgaaatattttctcggcataaaaatacaccgtaccattatccaaatcaagtgggaactcacttcggaatatacggacacacacgtcgctgacgtgctgacccttgatccgggactttcggatgcggaaaaggctaaactggtaaacgaccggatagccgaaatcgcccgtgaacatccgtcctgtaaaatcacgacggaatacgcccgcagcgcaccgacggaagaaacgccatcaggcgacgtgtaccatctgctgtggtcaagcgaccgccttgagatagcgcgagaggtggacagcagaatcaccaagatatatgccgacttggtatcgctggaaaagatgatgcactacaagcggagcatccttgacgtgatgaaggatgtgcagcccggactggacacggacgaaggccgtaggctgacactcgtggaggaatgccatgaccgctgggtggagaatgcacggacgcttcggagcggcaacagcaggaatagcagaaaggaggtacggccatgaaacgtaccatacagattgccgtcgtgctgttcgccctgctgcccggtatcgccaaggcgcagtggactttcgatatagtctccgtcgaagcctacatcaacgaccacaagaagcagcgcagcctgctgttggctcgtagcaccttggagtacagcaacaagctgttgcacgagtacagctgtaaagaaattggggactataaagagttgaatattgaccttgacaaatacacccgtgcgttcgatgccatcgacgtcatgtaccagtcgttgcgcacggtgttgaacgtcaagaatacctatacatcggtcagcgaccgtatcggcgactataaatcgttgttggaggatttcaatgcgaagatcttgaaacgtggacgcatcgaatccgcagataccctgattatctccatcaatgcgagggggctgagggcgattgcccgtgagggggaacagctctacaagtccgtgagcgacctcgtgctgtatgccaccggagcggcagcctgctcgacctccgacctgctgatggtgttggaggccatcaaccgctcattggacaacatcgagcggcatctgaaccgggcctatttcgagacatggcggtacattcaagtgcgcatcggctattggaaagcaaaggtatatcgctcccgcaccatgcgggagattctcgatgacgccttcgggcgttggcgcggagccggaagactggattattaacgacaaaaagagaagaatatgaacagaaaactattactcatggcagtggcggtcaccgtaacgacagccgtacacgcacagtatgtaacgtacaaccatgattcgccgaagcagaatcaggtaacggtcatggaaaccggtacgggcgcactctcgcccgacctctattattccgtgctgcacaacaaatacaagaagtcggcggcggccaaaaacaagctctcgttccgcacacttgccggtatcaatctctacaaccaggtggacgaagcggaagccattgattcggctttggtcaagcgggcgaaggtcgaggcgttgaacgttgccgaccggcaggcggacatcgcgtggcttgccgagggcgataaggtcagcagacagatggaccggttccggcgcaacatcgaccgtattctcctgtccggcggtactccggccgacaaggaacggtggacggaatactaccacgtctatcagtgcgccatcaacgccacgaaagacgcctatatgccaaacgcccagcgaaagaaggagtatctgcgcatctacgaggatgtggcacggcagaacgagattttagtgagctacctcgccaagcgtcagaacgcaacggcaacaagcacactgctgaacgcaacggacaaccgtaccctgcataagggcggcattgtccgcaatgccatgagccggtggcaggaatcacgccttgcggtgcgtggctcgcaatcgggcggcaacggaaacggcgaagatgacaacgagagtgtaaacagagggaaataaaaagacagggctatggcaaacggagatatactttcggatttcggcatcaacctgttggaggaggaaatagatgatgtcatctttcagaccaacgagtttctgacggacgcgacttttaccggtgcgcagggtcctttttggtggatattgcagatgtgcatggcactcgcggcactgttctccatcgtcatggcggcaggtatcgcctacaagatgatggtaaagcacgagccgttggacgttatgaagctgtttaggccgcttgccgtgtcgattatcatctgctggtggtatccgcctgcggacacgggtatggcggggagccggaacaactggtgttttctggactttctgtcctacatcccgaattgcatcgggtcgtacacccatgacctgtacgaagctgaagcttcacagatatcggacaggttcgaggaagttcaacagctcatccatgtgcgtgacacgatgtacacgaacctgcaggcgcaggcggatgtcgcccacacgggcacatccgatcccaacctgatagaggcgacaatggagcagaccggcgtggacgaagtgacgagcatggaaaaggatgcggcgaagttgtggttcacgtctttgacggcaggagtcatcgtggggatagacaaaatcatcatgttgattgctctcgtggtgttccgaatcggttggtgggcaacgatttactgccaacaaatcctgttgggaatgctgacgattttcggaccgatacagtgggcgttcagcatcctgccgaaatgggaaggtgcttgggcgaagtggctgacacgctatctgacggtgcatttctacggggcgatgctctacttcgtgggcttctatgtgctgctgctctttgacattgtattgtgcatccaaatcgagaacctgacggcgataaccgccagcgagcagacgatggctgcctacctgcaaaactcgttcttctcggcaggctacctgatggcggcttcgattgtagccctcaagtgcctgaaccttgttccggacttggcggcatggatgataccggagggcgacacggcattctctacccgaaacttcggcgagggcgtggcacagcaggcgaagatgacggcaaccggagggttgggcggcatcatgagataatccgcaaaagataatataaacccaataaaaatcataacaacatgaaattgcaagagaaaatcaaaagttggtgcaaggatgagaaattcatgtcctttgcacaggaacgagcgagaaaagaggtttgcgaggtgacggaaaaccaccgcatcgacccgcagtatgaagaactggacgaagccttcgagtacgacgaccggtacatcgcccccttggtgacgtacctgacgtacaagctgcgtcttgccctgctgcagcggaacgcaggtaagcgcaaaagaggaatctggtgggtgcttgtccacgtggagatgcagggctattacgtggagatattctcggcggagttcgagaatcttttgacggaacttcgggatgcggtcatacccatgctgcacacggaatatgtacagatgttgaacggtaaaagggaataaccgatggtcatcaagaatttggaaaacaaaataagactggtgggcatcatctgtaccgcttttctcgtgggatgtgtcatcatcagcttgtcaagtatctggacagcccggacgatggtctcggatgcgcagaagaaggtgtatgtgctggacggcaacgtgcctatcctcgtgaaccgcacgacaatggacgaaacgcttgacatggaagctaaaagccatgtggaaatgttccaccattattttttcacgttaccgccagatgacaaatacatccgctatacgatggaaaaagcgatgtatctggtggatgagacggggttggcacaatacaacacgctcaaggaaaagggtttctactccaacattttgggtacgagttcggtgttctccatctattgtgacagcgtggctttcaacaaggagaagatggagttcacttactacggacggcaacgcattgagcggcggagcaacatcctcatgcgggaactggtcacggcggggcaacttaagcgtgtgccccgaacagaaaacaacccgcacggattgcttatcgtgaactggcgaaccctgctgaacaaggacatcgaacagaaaacgaagatcaactactaaacaacggagtttatgaatatcaagggattcaggcggatgctcttcggtgaaaagatgccggacaagaacgatccgaaatacaaagaccgttacgagcgggaggtgtccgccggacgaaagttcgcccaagcgacacgcattgacaaggctgccgccaaggtgcagggattcgccaacgcacaccggatactttttctggtcatcgtctttggtttcgctatcggagggttcacttggaacatctatcgcattacaatggcataccgcaacagccggccgacacgcacggcgacggaaatgcaggattcggtgctacgggaaagacacaagaggctgcaagggggtgaaataagggaaaatcggaacgagaacaagaaatatgaaccgcaataaaggagtgcttatgaatacacgatttgaaaaatcagtccgctcgtcggacgaatggtacaccccgaaggaggtgttgaaagcgttaggcaggttcgaccttgacccttgcgcccctatccgtccgttgtggccgaccgccgaagtcatgtatgaccggaacatggacggattgtccctgaaatgggaagggcgtgtatggctcaatcctccgtactcgcgtccccttatcgaacagtttgtccgaaagctggcggaacacggcaacggcatcgcgctgttgttcaaccgttgcgattccaaaatgtttcaggacgtcattttcgagaaagcgacgggcatgaaattcctgcgccaccgcatccggttttaccgcccggacggaacacgcggcgattctcccggttgcggcagcatcctgatcgcattcggagtggaaaacgcagaagtgctgaaaaactgcagcattgaaggcaagtatgtacaactcaattaaaagatgtatgatgaagatatttgataaaatcaatttcagggagccgaagtatatgcttccggctgtcctgtatatcccgcttctggttgcatcgtacttcatcttcgacctgtttcataccgaaacggcggagattccggacaagacgctgcagacaacggagtttttgaaccccgatttgccggatgcccggcttaaaggcggtgacggcataggcagcaagtacgagaacatggccaaatcatggggtaagatacaggattactccgcagtggataacatagaacgagatgaacccgatgacaacaaggaagaatatgaatcgcaatacacggtggacgacatcgccttgctcgatgagcaacagcaggaaaaggctgcggcagcgcaaattgccgatgccaagacacgcgagcaagaagctctcgcggaactggagaaagcccttgccgaagcaaggttgagaggacgcaatgaggtattaccggcgaccgatacggacagtaccgcatcggcgcaacccccgacggcaaccatagaggtcaagggaaaaatagaggaagagagccgttcggtaaaagccccgtcagagaacgaaccgcccagcgaagtggtacgcaaggtaaagacggcttcggattacttcaatacgcttgcggtcaatgcccgtgaaccgaaactgataaaggccattatcgacgaggacatcaaggcggtggacggctcgcgtgtgcggttgcgtctgctcgacgacgtggagatcaacgagtgcgtggtcaaacgagggtcgtatctgtatgccaccatgagcggcttctcgtcggggcgtgtgaaggggaacatcaccagcattctcatcgaggacgaactggtgaaggtcagcctgtccctttacgacacggacggcatggaagggctttatgtaccgaacagccagttccgggaaacgagcaaggatgtggcaagcggtgcggtgtcggggaatctgaacatgaataccggcagttacggcaacagtctctcgcaatggggaatgcaagccgctacgaatgcctaccagaaaacgagcaatgccatcggcaaagctatcaaaaaaaataaggtaaagctgaaatacggcactttcgtctatctggtgaacggacgtgagaaacagtaaaaacggaagccatgatagagattgacaacatatataatatggactgtatcgagggtatgaagctcatggcgaacggcagtgtcgatgccgtgatagcggatttgccttacggcgtgttgaaccgtagcaacaaggcggcacactgggacaggcagataccgctcgaagcgttgtggaaacagtaccgcaggatcaccaagccgggaagccccgttatcctctttgcgcagggcattttctcggcgcaactcatgctctcgcaaccccggatgtggcggtataacctcgtgtggcggaaagaccgggtaacgggtcacctgaatgccaaccggatgccgctacgccagcatgaggacatcatcgtgttctacgaccgtcagccggtatatcatcctcaaatgacgccgtgtccaccggaacggaggaatcatggacgccgcaagacggacggtttcacgaaccgctgttacggtgaaatgaaactggctccggtgcgtgttgccgaagacaagtacccgacctctgtcatttccatacccaaggaacacaagacaggagcattctatcatccgacacagaagccggtagccttgatagagtacctgatacgtacctataccaacgagggcgatgtggtgctggacaactgcatcggttcgggtacgaccgccattgccgccatccgcacggggcggcattacatcggattcgagattgaaccgacgtattgcgaaattgtcggacgacggattcgggaggaactggaacgtggtcatggattaaagaaagcgaaataagggaaataaagaaataaacaatatcaacagaaacgatatgaacaagaaaataattgtaactgcatttcttctggcggcaggactttttgccacacggaacgcacaggctcagcgtacatacgaagagatggaacggctgactgtcaatgaacaggtaacgaccgtcatcacagccacggaaccggtccgcttcgtggatatttccacagacaaggtggcgggcgaccaacccattgagaacatcatccggttgaagcccaaagagacgggacacgaggacggtgaagtgctggccatcgtcaccatcgtaacggaacgctatcgcacgcagtatgcactcatctacaccacgcggataagcgaggcggtggcagacaaggaaattcagctacaggaacgggatgcctacaacaatcctacggtctcgatgtccacagccgacatggtgcgttttgcaagacgggtgtggaactcgcccgcgaaaatccgcaacgtggcgaccaaggcgcaccgaatggtaatgcgcctgaacaatatttactcggtgggcgactatttcttcatcgacttttccatcgagaacaaaacgaacatccgtttcgacatcgacgagatacgggtgaaactgtcggacaagaaactttcgaaggcaaccaacgcgcagaccatcgagctgacgcctgccctggtattggaacacggcaagacgttcaagcacggctaccggaacgtgattgtcgtgaaaaagatgacctttccgaacgacaagctgctgaccatcgaaatgacggaacaacaaatcagcgggcgcaatatcagcctgaacattgactacgaggatgtgctgtcggccgattcatttaacaccgctttattggaggaggaatgacgatgaaaaagacgataatactgatgcttgcctgcatgtgcgtcttcatgaatgcaagtgcgcagcgtaacagcggccgcctctcgcttggagtgggattgctgtatgagaacggcatggacgtaacgcttgcttacgaacatgaaatgaactaccgccatgcgtgggagtttttcgccaacggctatctgaaatggacggaatgtaaatcttgcggtcatatttgtccggaatccttctggcgcaactatcgcacttacggtttcggtgtggcgtacaaaccttgtgtggtgcgtggacgcaaccattacggcaacttgcgtatcggagcttcggcagggagcgacacgaacaagtttcttgccggaatccatgtgggttacgagcacaattatgtgctgcggtcgggatgcacactgttctggcaggtaaagagtgacatgatgataaaaggggcggatttgctgcggacaggtatcgtgctgggggtgaaactgccgataaaataaaggaaaaacaaaaaacgaaaataacatgatacgaaagattcaatggtttgcaatggcagtgacggcggtattgtgcgctgcctgtgacgcccatatcgacgtacctgatacggcggtacgtccgggacatattctctgcgaggacggtacggctttatcctacgtacagtatgaacagtcgggaaaacgggcaatagcggttgtcttcgataccgaacaccgtgaaggtacggaagggaacggctatgcggtttacctgtgggacattgctccggcagcttttgccgacagcctcggtgtcgcacaagggacgtcggccgacatcgaggctttggacgggaacatgaacacctttgcgctgtacgacacacgggagacggcttcgcctatggcggaagcggtctttgacctgtggcggtacggacagagtgcctatatcccgtcggtggcacagatgcggctgctgtatgccgtccgggaaaccgtcaatcctgtcatcgaacggtgtggcggccatccgctgccgttggatgaaaacgactgctggtactggacatcgacggaggtaaccggacaggaaacggcgaaagcgtggctttactcgacaggaagcggtgcgatgcaggagaccccgaagacacaggcgcacaaggtgcggccgattatcacactgaacaggtaggaacgaaaagagggaaaggacaaagacaatggaagaaagcaaggaactacaaggattttacaaaatattccgtgcggtcatctatatctccgtgctgatggagttcttcgagtatgccatagaccttgccatgctcgaccactggggcggcatattgattgatatacacgggcgcatcaagcgatggatgatctataacgacggcaacctcgtgtatagtaagatagcgaccttcctactcatctgcatcacttgtatcggcacacgcaacaaaaaacacttggagtttgacgcacgcaggcaagtgttatatccacttatctgcggattgttcttgattgtgttctccgtgtggctgtaccatcatacgatggaaacgaggctctacaccctgccgctgaacatcatcttctatatggcggctacgctggtcggtgtgatattggtgcatatcgcattggataacatctcgaagttcatcaaggagggactgggtaaagaccggtttaacttcgagaatgaaagtttcgagcagagcgaagagaaggatgagaaccagtatagcgtgaatataccgatgcggtactattacaaaggtaaatttcgcaagggatgggtgtcgataagcaactgtttcagaggaacatgggtggttggaactccaggtagcggtaagacgttcagtatcatagaaccgttcatccgccaacatagtgccaagggcttcgcgatggtggtctatgactacaaatttccgacacttgccactaaactttactatcattacaagaaaaaccagaagctcggcaaagtgccaaaaggatgcaagttcaacatcatcaacttcgtggatgtggagtacagcaaacgggtgaaccccattcaggcaaagtacatcaataatcttgcggcggcgagcgaaacggcggaaaccctgttggaatccctgcagaaaggcaagaaagagggaggcggaggcagtgaccagttctttcagacttctgccgtgaactttcttgccgcctgtatctactttttcgtgaactacgagcgggaaccctacgatgcaaacggaaagaaactgtatgcggagaaacggcaagatccgcagacgaagttctggaagccgacgggtgtcgttcgtgaccgtgagggtggcagcatcgtggaacctgcctattggcttggaaaatactcggatatgccgcatatcctttcatttctcaatgagagctaccagactatttttgaggtacttgagacggacaacgaggtcgcgccgttgctcggcccgttccaaacggccttcaaaaacaaggcgatggaacagttggaaggtatgataggtacgctgcgtgtctataccagccgtttggctacaaaggaatcttactggatattccacaaggatggggacgatttcgacctgaaagttagtgaccccaagtcacccagttatctgctgatagccaacgatccggaaatggaaagtatcatcggagcgttgaacgctctgatattgaaccgtctcgttacccgtgtgaacaccgggcaggggaaaaatattccggtcagcatcatcgtggatgagctaccgacactgtatttccacaagatagaccgactgataggtacggcgagaagcaacaaggtaagcgtaacgctgggttttcaggagttgccgcagttggaggctgactacggaaaagtgggaatgcaaaaaatcatcacgacagtgggcaacgtggtaagcggttcagctcgcgcaaaagagacactggaatggttgtcgaatgacattttcggcaaggtggtacaggtcaaaaagggcgtgacgatcgaccgggacaaaacgagtatcaatctcaatgagaacatggacagtcttgtacccgcctcgaaaatttcggatatggcgacgggatggatttgcggacagacggcacgtgatttcgtgaagacgaaaaccggtacgggaggctcgatgaacattcaggagtcggaagagttcaagactacaaagttcttctgcaagacggatttcgatatgagggagataaaagcggaggaagcggcctatgtaccgctaccgaagttctacactttcaagtcgagggaggaacgggaacgcatcttgtataaaaatttcatacaagtcggacaggatgtaaaagacatgatagcggatgtactgaacaagcgtggggcgaaataaatcaaaatccctgcaataatttacgtggttattgcagggatttttgtattccattcagctacccgaaatcttgcggacataaatgaatcatctgacagtttccgatttggaatcgttttccgacagcagattttgtaatttgtcgatgtccggtagagtcttgcgcaaattttccggcatttcttgggctgtgcggtatgtcgccacgcccataggcttatcatagtcgcgcaccatgatttcgacaaattggcggttggcatcctgacataggacaataccgattgaagggttctcgtgcggtttcttgtcggtcatatcatatacagtcagataaccgctaagctgtccgagataattcgggcggaacttgccccgtttcaattccacgattacgctggcattcagttctctgttgaagaatacaaggtcagcaaacatttcctctccggcaactatcaggcgatgctgactgtcgataaaagtgaagtcgtttccaaaacggagaatgaactgcttgatattggttacgatttggttttcgatgaccttttcgttccagtcctgttcgcgttctcccacattctccagattaaccatttcgagcatatactcatccttgaacgccaatgtcgcttttacggcataaatggcttcgggcagcacttgaaggaagttgctcggcaaagatccgcgatttgaatagatgtcttctttcaagtaatttttgagagaggatagcgaccacgcattttgagcggcacaatggatatagaacaatcgttctgcgatgtcttttgaacgagtcaggatttcaatatgatgtgaaaagctaatcttgacaaaatcgtcccaggtaaattcggtattgaccggttgcccgataagttgcagcagtagatgctcgtcaatatccaattcgcccaacgctgttggatgaattaaagccgtacccttttccgacgaatggttttccaattcgcccaacactgttggacgaattaaaaacgtcctccattcctcatagaatgagcgcatccgtttcaaccccgattcagaaaagccgtgcagaccgggcaactcccgttgaaggagctttgatatggtaggcaatgctttagtaccccaacagccgatgcgggaattttcagacacgaatttccccactccaaaatacaacgagagagtttctttgttgaccgcagccgcacttctataccggcagcgttcgatggcatgtttgattatctctactgcctctgcatattgtgtataatccgatgggataacttgttgttccatatacatacgtttttgtgccgcaaaggtacgaaaaatacgggatatacagggcagaatgccaacatattatagtgccgtgtgggtcttattcggtatttttagcgttccggtttcctgcactcgctttgctgccaatctactcacttagatgttcatgtgtctggggcgtgccgagaaagccggtagcggtgtggataagattgtgagcggttggcagtctttgggttggccgcttcctactgtagccgaggaaacacgtccggactatgttgtgctgaccttgcagttagggatgaaaacccgacaagaaaacctcgcaagcaggatttgagaaaagagcaaatcttggagttctgtgttgagccgcaatccctatctgatattttgcaacatttaggattgaaagatagggaaaatcttatggaggtctatatcaatccgatgattggtgcaggggtattggaaatgacggagccggacaatcccacaagccgtaaccagatgtatgtaacggtaaaagtggaacaagaatttcaaaagtaagtttataataggatattgcggcttggacgcatccaacctcatacaaataacactgcccgcgtgaaaatgggggcagtgttatttatatggtagttcgcttatttaagctcgtgtaccgcttaaaagttcggcaagttgccggtcgcagaatttatcgtattcctccttgtctgtaccgctttcgatagcccggtcgataacatcgcccagttcgtcgaagcagacttcttcattgacacactttgcattgctatcatcttctttcagtagatagacctcgtagtaatcagagccgttgagagcgataacgacatatccggcgtgtaaccgtccgtttactttcagccgcagtgccggtaattcttggaataccgtagcgacaaattcgctgactccccacgacataaagacgggtatgggggtaaatgacagtaattgttctttgatggtctgtgcgatgtgcattacatactctttatccataactttgatttttaatatgattattgatttatgttagttgaaccattcggggttatcctcttttaattccgtgatgagttcatcgtccggtaatttgagggtcttcgcatcggcgaaaaagaaaacctcgtcatatatttgttcggcttccttacttgcaaaaccttcgctctcgtcctcgaaactgcccggatgaagtgcatcgagcagagcggtagagccgataagtagttcttcaccttcgttggatttcacgatacggcagatgtagatattgccgtcaaattgtagttctttcgttttcatacgcctgttatcttaatgggatatgtctcccgtttgccttgaggtattccatgatacacttcgcttcttcgtgcgatgcacggttgcggtcatcgtaattgcgtgtctcgtctgccatgaccacgatacactcctttaccaacctgtaaaggctttgctgcagcgtggggtgcatttcggggatagcggctgcaaaccgtttgggattgaagccgtaatcgttcactgctctttcccagtctttggcgagctggtactccttgctttccttgatgttgtccataatcttgaattttaatgatttgttttttattccctccgttcgattcctttctgtcggaaccgctttgggattttatagatgcggtaaacggttgtcggtacagcttcatacgggaggcttttcctgccaattactctttctgagggaaggaagaatttgcaggaaatacatttcaagccgccggatcaagcgcgacggccgacctttgcatctgataaaaccaaaccggggctgacagggaatgaagctggggaaacgctataaaagggaagttgaaaatggtaaaaaagagaggaaacgaaagctatgaatggaggaagggtgggtggtgacgggttcgtcagaaagttaaaagaggtacttgggtcctttgtccggagcatacaaaaatgaatagagggcggatttccccccccctattcgttatgacaacaacatttgtcaggcagctatttcttccgtttgcggttcggtctgtgcttccgcttcgggttgcggttcatcgggttgttccgcttcctgcgtggcttgttcctgcaaagcggcttttttttccttaatgcgttggtgccgcttttcgtacacttcattatatccgtcttggatattggcaagttcttcgggcatatgcttttgggcgaagccaagcaacagggaggctgtggcgttgttaccgaatgcgtccttgaaattggcaatcagataatccctgcggataacggctttctgcttggcggtaaggttctcgatgatgcgcattttgtcctcgctcgtaaggtagtaataagaacctttatcttcaattcccacctcattgaaatgctctttgcggagtgaggagagcaggaagaaatacaccattttctcctcgtcctgtccaaatttgcgctctgacatatcgacctctaaaatccgctttttggtgtcttcaacggtcttttcgagggcaatctccttgttgcgtttgtcctgcttttccaacttctcgataggtgaaagcggcatttcggttgctgtaccgtttacggtggtagcggtatttgcaacatagcacagtgtaatgtcgttgctctcaatacggagatagagggagatttctcctgcttcgcttcgggtgcggattgcttcgcatttttcggtgtaaccgttcaattcctgcccgtaatccttttctgcatcctcgtattcctcggtggtatcataatcctctttttgaggtgcttgggggctttcggggtatttcgttgcataggttttaaggctttccacttcgtagcccatagcggtaagtcggtcgatgacagcttcattgtaattgtagctttcgtggcagaggggaacggcagggtgctgttccatgagccgcatagccttttcggtaaggtgcgatgtgttcatttccaccaagcaagcgcggttggcgcaatttccgcaaccaccctcacagaacaacatcatattattggtattgtgagggcatgaaagacaaagggttttgtcgaatgaatagcgattgaggtctgcggtgtattgccgttcgatgctttgtgccacctcggaagctttcatgcctcgccaactattgtactgcaccccctctttcagatgttggtcgtacacctcacgctgtatctcttccccataacggcagatttcacttgccacgctgattgtgatttcgtcctgctccaacagcaaagcgatttcgggtatcaaggaaacgaatttaagtcgtgtacggatatatgcctccgtcttgccgaactgcacggtcaaggactgtacatcgtggcgaccgctgtctatgagcttttggtaggcgttggcttcctcaatcggggtcacatccttacgctgcaggttctcggtaatcgccatttcctcggctgtctcgtctgaaatttccatgacgatagccggaatttccgccaattcagccatgagggaagcacggtatctgcgttctccgaatacaatctcgaaacggttgtccgcaatagggcgcacaccgataggctgaagcactccctgctgacggatgctctcggcaagttccgcaaggcttgtctcgtcaaagttcttacgtgggttgtagttactcggctgaatgtctgccaatgctaccgatgtgatgttcttctctactgcttgaactgctgttgttgccataatcataaaatttaattggttgatatttgatttttttattttcccttttttcggttcttttctctgcctgaaccgcttgggatttacagatgcttcaagggactgacgaacaagctattttcaacgctttttccggaaaattactctttcgcaggaaggaagaattttacgagaaatgcacttcaaagcggtgaaatcaagcgcggcagtccaaatttgcgtctggaaaaccaaccggcgatggcaggaacgaggccggacaagcggcaagtggaataaataaaaaagtaatacaaccatgcggttataagaggtaatagaacaggagaacacccaggagggtataaacaggaaaaacgctaccttgtggacgtgcccataagatagcggtatgctataaaaggtatatcggatggggactacaaccgccgtaccggttatttctcgtgcttttccaaatactctttcatcgcctcgttcacgatgtcccgtagagacatattcttttcgatggcgaggtacttcatccgggtatgaatacttttgtttatgacaaagttgcaatgtacagcaggctctttttccgttttgaccggtgcaggttctttcttttgcgtggacttcccggtggatgacagcaagccgtccagtccgcttctcatgccgtttttcaatgaatcacttttgcccatatcgtttttattttaatttcaacacttcttttgctaactccatgtagtcctttgccccgttgctgttcttgttatactcaaagatattcatgccttttatcggagcttcggccaatgatacattgtcccggatgacggtcttgaataccttgtcgcagaacgattcgctgattagttccgccacacttttgttgagcgtcttgcgcttgtcaaactgggtgatgacaatgccgccgatatttaggtttgggttcaaacgttccttgacaatcccgaccacatttgtaatctttgccattccgcgcatggcgaggaactgcgcctgtaccgggataatcaggaaatccgccgatgtgagggcgttcagtgtcagcaaacccagcgagggcggacagtcaatcaggatatagtcgaatttacgggtttcaagcaattttgcaatcagcccttttagtattaattcccgccccggctcgttgataagctcggattctgtcgccgacaaatcgaggcaggacggtacaacggaaagaccgttttccaactcgaataccggtaaggtatattcgcctttcatcgctccgtacaccgtccgttcctcttcgatggagagaccgcaggattccgtgaggtttgcctgaccgtccatgtcgatgagcagtacacgctttttcttctgctgcaatgcggcagcaagattgatggtggtagttgtctttccgacaccgcccttgtggttcaaaactgcgattatttttgtcataatttcgtgtctttatatctgatacaaagataatactatttttagtatttactattattagtgtatactattttactacttttgtatattttagtattatagcatctactactatactaaaatactgattgactaaatgtagtgcattctatcatttctgatgggatatttcctaatatcctactttactaaccttagtatatactacatttagtatttgttgtataacagcaaaataagctcattttggaattagtcttataaatcatcatcatgcgcattagataaattctgtctcaagtgcttccaacaagtcgtgtatttgtttttccgcttcctccatatccgatacaatgtccttgatgtggtaaggtgcgccatttttaccgtgcccatcatttccaatccatagataggcttcgtaatccgggtcaaaaccctcgaaatattgttccatgtcagcaatgagggtatcaatgtcctcacatttcatttcggcactgaaattaaaatcctgcccatagttggtatagcgttggaagtcgaactgaatatttgatttatttttgtcatccacacttatactccagcctttgctttgggatatttccgttactttttgtatcttttcttgagcggtcatagttttgagtttatagtggggagacttcacaccgtcctaccgattgctttaatccgttatttgaaagtaatactcctgcagctcgtctggccattcggcggtcatagagcgtggctttctggttgtcccgctcgtgccattgccaaattttgtgattaagtacaaggcacagctctgtccaatgcttgtagttatctttccattctgccttaacctttctgtatgtgtcagctatggcttcattcccgaacttgtctgccatagagaagtcctgccaaaaggttgtcatcgggtcatagccagtaatttccgctatattccacttgggaattactatttttaatatttccatacttattattgtttttgtaatactcatgaatcaagattactatttccctttgttcggtctgtttgcgaccgccgggaagatttttctgctttcagaaggtggcggggaacaatcggacaaggctgatccggaaaaatacgctcgacagcggagaggaagatttttacgtgtcatttgcggcagtatgccggcattggcaggattggagccgccggttacctttgcggaaaattctgttccgtaggtcgcacggcagcggacttgggtttaatgggaatccgttagaaaaggaaagatttatgaataaaagagtgaggcggccagccgggacggactttccgatggactgtcttgggactacagagggcaggatttatcccgccccctgtaatgccaagtctgtccgtgtccgtccttttgcaaaaaggggcttcacgcactttatgtaacgtgttacacaaaatgcgtgaggctgcttgaagcaaactggccgcaggatgtaaggctatatgagggagaaaggaattttataaaaggccgttggtcgatcggaacaacaaaccgtaccgagactttgcccgatacggtcttgcatataactcagtctatgtcatagcctatcatgtattcatcgttgataagcagataatagtagccgttgccacaattcctgtattctttgctgaatccagccgccatatctccattttcgcgtggctcacaccataacgtaccgtcatagccacaaaagtcgaagcgtccggtggaaaacttttcgccttgcttcagtgccgttctgaaacgagccatatcccaactgctgcaatacttctcgatggtggcaagtccgatacacttgccgtcgatgcgtgtgccggtcgtgatgcggttctcgtagagggatttatccaaatcggcattagcgattttgcgaagccaatcattcgtatgcgtggcaagtcgggcaagtttctggtatttcaagacctgtttctttcctatgtccgctgcatcttcgggagaggatgacggatagtatatcttctcaatgcttgcccaatccgtgaagatgtacccgctttttcgttttcttggcgcaataatgccgatgacgttttcattgcggttgatgaataatcgcctacgttgtcctgcaatccttacatataaagaggtggaattctgctcgtttcggagataggcttctgccggatgaatagttgttgtttccatatttgtataaattttgatttttgctgttcctattttggtttacctgttcaaagttccgggattgtgccgttcttatatagaacaccgtcccgataatgggacacgatgcccggcttaagtcccatttcctcaaaggctatatgcctgatatagtccttgtattctttgccaatgaaattctttccacaaaggttgttgaaaatcatagggacggaaaaaccgtcttcgctcgataatatcactttgtcgtcttgtctaatttcttctaccatacttgtttacttttaattggttgaactatcatgctgatttttctttttccctgctttcgtttgccgtgcaggtttgttttcagctttttgaggcagccagaggatgaagctgtggcatcataagccaaacccggatagaaaaccgaccgtgtaacagtctgttttcgtcatccgaatgcaatgcggcttggcgattatgcgcttcgtcctacattcgccgacgaaaagagtaaagaatgacctgccggtaaaagcaaggattttgtaaaaaagaagagtcgtatatgatagaaaaaacggcttgggatgtgagaaaataccctgaaaaatttgcggtgtatcgtattttatgtaattttgcagttgtatttcaaaattgcataaacagtatggaggcaaaatatatccacagggagctatccgccgtgatagaagaggcttaccgctatttttcagtcattacggtaacaggaccgcgccagtccggaaagacgacgctgctccgcaacttgttctcatacctaccgtattactcgttggaaaatcttgatgtccggagtttcgccgaaaacgacccggtcgcttttctgaaccagcacacggagggcatgattcttgacgaggtacacaacgctccgaacctgctgtcgtatattcagggtatggtggacaatgatgccgaccggcggtttatcctttcgggcagttcgcagtttgccatgctgaaaaaggttacacagtctttggcaggacgtaccgccgttttcgagttgctccccctgtcatactccgaaatacgggagcagatcaccgatacgcctcttgacaacctgctgtttaacgggttttaccctgccatttattcgggccgtaacatacccaaatttctttatccggcgtacatgaaaacctatctggacaaggacgtgcgcgacctgctacaaatcaaggacatgatgcagttccacacattcatcaggctttgcgccggacgtatcggatcgctgttcaaagcctctgaactggccaacgaaatcggtgtcagttcacataccgttacggcatggctgtccgtcttacaggcatcttatattgttttcctgctacctccctatttcgagaacacacgcaaacggctgactaaaactcccaagctctattttacggatacagggcttgcctgtcacctgctcggcatcgaatcgccggaacagcttgcacgggacaagatgcgtggggcgttgttcgagaacttcatcgtaacggaagccttgaagcggcggtataaccaaggcaaggaaagcaacctctatttttacagggattcgaaccagaacgaggtcgatttgctgttgaaaaaacattcggggctatacggtattgaaatcaagtcggcgatgacctaccatgcggacttcgagaaggcgttgaaacaaatggacggctgggtcaaagaaaccatactgggtaaggcggtggcctatgcgggtacactcgaaaatactgctggagaaatcaaacttctgaattacagtcacctggatgaggtgttggcttaacagccctataacagtccagctaatgccgacacacactcctgctgcatggatttgatgtaatcgaagagaaccgagggattgatattcttgccatttagcttgcaggtgacgtgcaagtgctcgcctgtacttcgtccggtcgagccggtaataccgacggcatcgcggggacggactaccgtacccttggcggccagcacccgtgaaaggtggcaatagctgacggtgtaatttccgtgccgcagtgtcacatacttgccggacgtcttgtcttgtcccactttgacgaccaccccctccatcatggccaatacctgctcgccccgtgcgtgcaggtcgatacccccgtgaaacttcctcttcccggtaaacgggtctttccggtagccgtatggcgatgtaattctgatgcgctgcaatggataagacacactgagataacggtcaatccacaacttcttactttcatcggcaggttttgtcgaagtctcctgtgcaggagccatgctttcgggtgtcggctccggctttttcataccctcctgcaaggcttctaccttgtatctttctggtgtcttggcaatcgtgttgaactgcgcctgaacgggcatcgtgcagaatgaaatacccgatattgctatcagtagaatttttctcattcggcaaagttataacgggaattttcatgtcggaaacaaactaccgtcatttcttgtattggtttgatattttgcgtctattagtacgattttgattagataattgtactaatgaagataaaaacagcatattacaaccatttatatagctgtatttttgtccgtcataataagatgtctctatctttgtatagtacaattttataatatgaatatagtatgaaaaaagttcagattgaatttgatgaattacccttttcgacactggaacgattcggtcttacaagggaaatgatcgaggacttgccgatgcgtgtgttggaagacatctgcaacggccggcattctcccgtgcttcccgtgcgtgtcactgacgagcatggcgggcaaatcgagagccgcagccgctttgcctttatccgcatggacgacggtcaggtggatgtggtgttctatccggcactgaaatcctctccactggagcggtatgacgaagcacagcagaaacagttgctcgacggcaaggcgattgtcgccgatgtggaaatgtcggacggacggagcagcaaggctttcgtacagattgacgccgagacgaaacaggtgatgtatgtccccacgcccatcatcgcacgcaacctgaaagtgctggccgaggtcatgcgcctcggtacggtggaggtaaacgggatgcagcacggcgagccgctgacggtagtcgtgggcggcgagcctgccacagtgggcatcgaccttcatgccaagaccggcatccgcatctgttcgggcgacgcgcagcaatggcgcaaccaacccaagcgagagtgggacaaatacaccttcgggtgctacggctgctgggtcatggacgatgacggtaaccttgactacgtttcggaggaagactacaccgaagagctgtggaacgaacagaagaagagcggcgagcgcaatcgtgcgacagctctccataagtaaaacatcaatccgtacattatggcacagaacgaatattatcccgaagacgtacttgtcgggaagatgcagagcggcgaatacggctggctcgattacgtcaatcatttctccgccgactggcaggaggaatacgcccgttactgcgaggaaaaagggcttgcagtcggcaacgaatccgccgccgagttcgtccgcttcaaggacgaacagttggaggcagcaatggaaagcggagacgcataacgaaaacaatcagactatggcgatacgaacgaataccaatccccggcagatggacttgcagcccgaaatgcgcgatatgctgatgcgcaacgggcttcaagcccatgttgcacttgacgatgcagggtatcggctgatcgtgcagggacatgactcgcccctgctggtctatccgatcaccgaacgtcagatgttggcactcacggactggggaacgaacactgccaacaagaaggcctacaacgtgctgacgagcatcgtgggcaaggacttctatatgcccaagaacttcgtccatgcccgcaatgccaacggtcgtgtggctatggggctgcacggctaccgcatcgtcatcggcgagtacgggcgcatggggcgtatgggaatgcccccgccgttccttggctggacacctcgcaaccagttgggcttccaccttcgcagggtcggcggccaactgttctttccggggccgtccatcgtacccgaacgccccgacgggcgcatgaagcccggcgaactgcaatcaggcggttacggcttctattacaaggggcatcaacaggagcagcccgtacagcaacgggatgtgctgcaggacttgcaggcggctatcacgccgatggtcagccgtccacgcagcaaggaaccggcacggccgtacaaggagcttatagcctctccggtctatttctccaacgagaaatgggcggagtgccttgcctcgcacggtcttgtcgtggatgcggaaaagcagacgctgaccgtgcagtcggaaagcgtccaagccgatatggtctatgacctgacggaagaggaagtgaggacactggttgccgcacccatcgaggagcagcccgtagagaaacgtctggaactgctgaacggcattatcggggctgacttttccgacaaagtgacgatggaggctctcaacagcgatcaacgcatcgctatcggtctgcatcccgaagtacagcaggatttgaaacaacgccaacggcaggagcaagaggcttttatgccagtgaaaacctcgctgcaacagcaagaggaatccgtacagggaaatatcggtgcggtagtggacgggcgtgacctccagtttttgaatgaaaacaagggatggtatcgggaagagaaacacgggcgggaagtcgaagtgagccagatagccgttcaaccggcacagaccgaggggaaatacaggatgaccgccgttatcgacggtcaggctatcagccatgagataacccaacgggactacgacaagttccttgctgtggatgactatcaccggatgaagctcttttccaagattttcagcgaagtggacatgaaaacacgcccggaagcacagcggggtctcggcacgaaaatctttgccgccctcaccgcaggtacggtagtcgcggcgggtgtcgcacacggcatccaccatcactgccatgccccggagttctacggcgagtgtttcggcggtccgccacgcccgtacttcaagccgggtgtcgatacgccgagggatgtggccatccgttgtttcgaggcagagatgaaccgtgaaatcaatgatatgagaatggggaggtaaaccatgagagagggcgaactgacttatgacgattttctgcgcaggctgaacattcaggacgtgcttatcgacgcgggctatcacctgaaccggcgtgacggcctgcgctatccctcgtatgtccggttggacagcgaggggcggcgcatccgcaacgacaaattcattgtcacgcagcaagggaaatgttgtttcaaaccgcaacagcagaagtcgtataacatcatttcctttatcaaggagcatccgcattttttcgcggaataccatgccggtgtgtctcccgaccgactggtaaaccttgtctgcaaccggttgctgaaccatcccgtcgctgaccgggatacccggattatccagcctaaacgggatgtgaagccgtttgacatggcggattacgacattcaccagttcaatccgcaggatcgggcgacacaaaagaagttctatccgttcttcaagcatcggggcatcgacctttacacgcaatacgccttccaccggaacttttgtctggcgacgaaacaccgtgaggacggcatgaaatacaccaacctcgcctttccgctgaccgttccgaaagatacgggacaggttgtcggtctggaagagcgagggcgccctcgcatggatggcagcggcagttataaagggaaggcggaagggagcaattcgagccaagggctatggattgccagcccagccaaaactacgcttaccgaagccaagcatatctactggttcgagagtgcatacgacgcgatggcctattaccagcttcatcaggccaacgacaaggatttgcggaaagcggtcttcatatctaccggcggtaacccgacggtggaacagatgcggggtgtcctcacgctctcgcttcctgccaagcaacacatctgtttcgataccgaccttgcgggaatcgagtttgccaagaacctgcaacaggagatgtaccgggctgtccgttccaccatcgaggagacaccggagcggaagccttatctggattccgtcgctgacggcaagaacctcgatgaaggagacatagacctgctgcccgacgctttgcggtcgagctacgggaaatatgaatccgcatgggaagaagccatgtcgatgcgttcgagcggcctgtgccatccggacgacatacgggaacagacggatatcatgaacggaaattacaaggagttccgtgaaggattgcgggagttcctcggtctggacaaggcgaatgacgcctcttttgtccgtgaacagcctacctatcccaacaaggactggaacgaacagcttttggccgggcagaaacaggaagagacggtcgatgagacacaggcgagagaacagtcaccggaagaggaacaacaaacacactttcgccgatgatgaccgatgcacccacaggacatttccaaagcatcgtgctgcaaccgcacgccggacagttcgtcatcgacgagctgcccgcaatcgtattgtgctgtgcagcatgggtgtacggtggcatggagggactgcctctgacagctcttgccgtatcggttgccgcattgctttctttggcattgctgtaccgtttcatctatctgcgccggacacgctaccacatcggtagcgagcagcttatcagcaggcatggggtgctgtcccggaagacggactacatggaacaatatcgtatcgtggactttgtggaacaccaaagcctcatgcagcagctttgcggcctaaagacggtacgcatcttctcgatggacaggaatacaccccggcttgatttggtaggcatcagacacaacttcgatgtggtaacgcttatccgggaacgggtcgagtataacaaacgaaaaaagggaatatatgaaatcacgaatcattagtctggtcatttttgccctctgcctgatgccacactgggcaaaagcccaaatcacggcgtccaatccgttggaatggatggcgttggccgagggcaacgaggttatcaatgaccaaatagagaaacagataaatggtcagacgaagacagctatgctgcagaacagcatcgccgccgagtttaaccgcatccacaaatgggagaagcagtacaacagttatctcaagacggtaagcggctacgcttcatcgctgaaagcctgcacccatctctacaacgacggcgtgagaatctttctcacgttagggaaattgggcaacgccatccgaaacaacccgcagggcatcatcgcctccatgagcatgaacaatctgtatatcgagacggcaacggaactggtatcggtcttcacgctcctgaatgacgcagtggccaagggcggcaaagagaatatgctcacgggtgcggaacgcagcaagaccttgtgggcgttgaacgacaaactttcggttttcagccggaagctgcacctgctctacctgagcatacggtactataccctcaatgacgtgtggaacaacgtgacggccgggatgctcgaccgcaacaacggagaggcggcacggatggccatgtcccgttggcgcagggctgccgtccttgcacgataaaatcaggtgaatgatgaaacggacgatttggataggcatcttattgctgtgcatcggtatcggcaaggttcgggcacagaacgaccccgtgcttgccgggatgatcctgctctataccgacaaggcggaaaaggagctgaagaaccaggagaaggtcatgctgatacagaccaccggacacctgtggacgaaagaggaagtgaaagccacgaccgacctgcaacgggagttcaacaactatttggactctttccggtcgataatctgctacgcagcgcagatatacggtttttaccacgaaatatcaaggctgacggacaatatgggagactttaccagacaggtaagccgcaatagtcccaacgcgctggccgttgctctctccacgcaacggaaccgcatttaccgggaactgattatgaacagcgtggagattgtgaatgacatccgcatggcgtgcctgtcagacaacaaaatgacggagaaggagcgcatggaaatcgtatttggcatccgtccgaagctcaagatgatgaacaagaaactgcaacggctgaccaaggcggtgaaatacacgacgatgggcgacatctggcgtgaaatcgacgagggggcacgcccggcagccgacaaacgggatatcgtggaagccgccaaaagacgctggcggcagataggaagaaatgtaagaccttaaaaacagacaacgtatgggcgtttggagtacactattgaaatatggcggcaaggccatgaaaggtgtcggtacggctacagcgactaccggcaaaagtatgggtaaggcagtgctgcacccttcgcagaccttgcgtggcgcgggtcaggccgtcaagacggcgaccatcggcggtgcggtcggttatgtgggctgggagaagctgaccaccgacaaaagcgtggtgcgtatcgtgagcgatgcggtcatcggcgaaccggcaacgaataccctcgcggagacggcggacggagtgcgtgaactgacgggcaaggccggggaagccgtcagttcggtcagcggtgcggtaaccggcatcgacaacaagctgaacggtgtgtcgaactttttgcgccaagcctccggtggcggaggccttgatatgttcggcaactttttccgtaacctcggcagcggcaacgtgtcggggctgagtattgccgggctggttgcggcggcgttcctcatattcggacgcttcggctggctgggcaagattgccggcgcattcctcggcatgatgctcatcggcaacaatgcgggtgtcttccgaacgccggagacagaaaacgtgcagcgcacccggacgcccgaacttccggcagaggaacagacgcatggcggagggatgagaagatagggatatgaatcaataggtaaacagcatgaaatatacagaagaaatgatcctgcaatccgatagcggttattgtatgcctttcgaggaacagcagggcaaagacgtggagctgtcgctcggctacggcgaacagaccgacccggcgacgggcgagaaattctttcatcacggcattgacttcaacgtgcggtgctatatgctttctgccctcgccagcggcattgtgtcgggcgtgggcaacgattccggacacggcatctgccagaccatccgctacggggagtatgaggtgacatacggaaatctgtccaatgtcttcgctcaattcggacagcgtgtaaaggccggacagacggtagctttgagcggtgacaaactgcacatgaccgtccgcttcaagggcgaggaactgaacccgctggagttcctgacgatgctgtacgggaacatacaggcaatgcgtcaggccggcggacacgagacagactatttatccggcttggagatggaactgaaaaccgattatgaacgggacaaaagggagatagaggaactgatgctgcacttcctgccgcactatatggaggatttgcggcatggagcatacaccttgccccggaatacggagcagtcgctacgccacatcttcacggtgggcgcgatgaaggagtatttctacgagaatatgccgagcatggccaatccgctcggactgggacacaaggccatgccgctggcctgcaaggtgcagaacctccttattgcggatttcctgcattacctcgccctgcggcatgatgtgtacctctccactgcgagcagcgacataaaaaaaaactccatgacgaagccctgacctatggcggcatcatagacccgttggcggaactggacatcgacatacagagcttcgacataccgaggcttgtcacggtctatcccgaccgggcgggtgtgcgctggtggaccaaggcatggttcaacaatcgggaagagggcgagacatccgtcgaaatcgaacgggagcaggcgatacggttcatgcaggacaacatcgaaaaggacgcatggctggaagagttctttccccggcagatggaggtttaccacaacgccatcgagcagacgaaagaacagctattgaaacagataaatatataatacacaacatggatggaatcagacatagccgacaattcgcggaaatagaacgtcttgtgagcgattatttccattgccatctcgctcccgtcatgtcgaaaacgcaggctttcctcacgaagaagcagggcgaggaaatgagggagtattccacctcattgggcggcatactcagcgcaatggcgtctgcggcacagccgatgggcgacccgtaccaggtactcaaggttacgggcgaatggaactcgaagacgacggaggactacatcggaatgtgcaaggcggagattaccggctccaaggagatacagcaagacctcgcatacatggccgggcaatggcgcgataccgtcgtgcgggaaatcgggcgtgaacggtacaacgaactgtcggaacaattgggcggtgaccttgcctacgcctatatggactaccgggtagaggaactgatgatcgaccggctggtcaaggagcgaatgccgaaatcgtcagccgactacatcatccgcaaagccgcagaatcaagcttgctcggactttcgcagaccttgaaccgctcgccgcttgctgaggaaatcgaggcacggggcgaagcggcctaccgtccgaaaggatgggaaaaaggtgcgggtcgggtattgggcgcaacggcggatgccgtcatgatgggtggcgcaggttcgtgggcgacattggcaaagtttgtcggggcggacgtggctatctcggcagtcgcctcacgcttcgagcctgaaaagtcgcccaagctctctgtggagcaatgtatcagcaaaggtgtgttcggtagcgaacggaacgtgtttacggacttccgtaaggaggctgcaacagtacagacgggtgatagtgcgcttattgtggcggccaacgagcagttgaagaaaaaaatacctgtgatgaactttaattttttggagtggatgcagacaccaaagtttacccctttccaaatgtccgaaaagcccggacaccctgaaaagaaaaatgaacgtgccgaacggtacaaggatgtgccgctcatcgtcgctcccggacaggaagaagcctatttgaagcatttggagaaatataagaatgcaacggctgtaaaatccacaaaggaatcaacacagccggaaatggaacagagggaaaaagtggagaaagaggaacggcaggtggttattccacatgaggaagaaaagcaagagagagaggctgtgcagaccaacacgaacggatggagcggattgctcggtacattgggattagagggattgggcgatatcacgggcaacctcggatatgtcatggccatgctgcccgacatcctgctgggagcttttaccggcaagacgcaatcgttgcgctttggggacaacctgttgccgatagcgagtattgtggccggtctgttcgtgcgtaacccgctgctgaagatgctccttgtcggtctgggcggcgcgaacttgctgaacaaggctggacacgaggcgttggggcgtcccatgccgtccgccgacgtgcatacggaaaaccagtaccgccgttatcccgacgaaccgctcaattcccgtatcgtaaaccctgtactgcaaggcagcacgctcatcgccacgatagaccgtgtgccttgtaccatccagctcacgccgaccgtcgcggaggcttaccgtgcaggggcattgccgctgaacacgctggcgaacgccgtgcttgccaagagcgaccagttgcgccatattgcctcgcagaattacgacgacggacagcgggagacgattgtgcgcacacggggcatccaataaatccatgaacaataaaagcatgatgatatgaaagaaaagtcgcaaatcgaaaaaaaagccgaagaaaagcagacggaactgctgtctgccgcactgggcggggcatcgaacgccggcggccattggctcaacgtatcgggcaagggatttccccggctctatccgcaaggggtctcggccagcccgttcaatgccctctttatggccttgcattcggacaataacggatgcaagaccaacctgttcacgctttacagtgaaaccaaggcacggggggctgcggtacgggagcatgagcagggcgtaccgttcctgttctataactggaacaagtatgtcaaccggaacaatccgaatgaaaccatcgaccgtaccgcctatctccaattggacgaagagcagaaggcacagttcaagggtgtccacaaccgagaaatccgcacgcttttcaatatcgaccagacgacgttgccctacgtggacaagccggcttacgaggatgcggtaaagcaggacggcagtgttcaggaaagaggatatgccgaggcggacaaccgcaggttgcgcactcggttcaacgactttctattgaagatgcgggacaacctcgttcccgtgcgctcggacggtagcggagttcctcattacgagacggacaaagatgcggtctatatgccgcgccaaaaggattttgagcattaccacgattatgtgcaggaagccttgcggcagatcgtgagtgccacaggacatcaacaacgacttgcccgtgaaggcatggtcatgaagaatggtgtggctccgtcagaggatgcggtaaaatatgaaaggttggttgtggaactggcttcgggtatcaagatgttggaactgggactgcccgcgcgtttgtccgatgcaagcctgaagacggtggattactggtgtcgggagttcaaggaaaacccgtgtataatggacgctctcgaaagcgacgtgaacaatgcgcttgatgttatccgaaaagcggaacggggcgagaaaattgagtacgccaccctgcgaaacagacggcagaccacgaccatgcaggaacagatgcccaagcattactttgtggcgaatgaaatccgccagcacccggacaaggcggcgaaaagcatcgtcctcgtcatcgaccgggaggcgaaatcggcggatgtcattttgccggcaggagcttcgaccgaggcgaacaacgagattcccggcatgaacaaggggcgtatcgaacgggcattgcagaaagagggtatcgagcaggtgcgtttctataatactgacggtgcattgggttacagacccgatgacagctatttcaatgaaaaaatggtgacactggcccggttaaggaactacacgttggaaaagctctccacgctggacgtgtcggaagctgtcagacgggcgaatgaggtcgggttcgatgccgtgcagatgattcaggatgacaagaaccgttgggcactctatatcaagccggaaaacaaggaggggtacagcgtctatcccgacaaggaggatgtgaaccgttttttctccacgctcaagcaggcgatggacaacatcgacaaggtacggatggagctggcgcacaagtattatgcactggcggaggtcaaacccgacctgaaagtggatttgttcggcagcgatacgccggagattgacctgaaccgtattcagcgtgttgccatcttcaagaccaggcaggatggaatccagtgtgtggcaaccatcgacggacaaaagctgcagccccgcagcgtcactccacagcagtggcaacggatgtgggtggcggaagaccgtgacggctacaagcggcatttggcggctacgctgtttgccgatgtgctgcaaaagggacaatccgtcggggaacagaaagcggaagagcaggtacggcaacagaatgaggtggtggcggaaaatcggtcggaagagacgaatgatgaaaatatgtctccgaaacggcagttttgggacaacctcaaggaaaagcatcccgacgccctgtatctgattcgtgcaggagaagtctatcggctttataatgaggatgcggcaaagggagctgatatattggggattacgatgaagaaatatccggaacgtggattttcggctttcgcagagttcccaaggacgcaactggacagctatctgcccaaacttgtccgtgctggtgagcgtgtcgccatcagtgagatagagctacaggataaacggcaggacgagcaggaaacacataggggtattcatagataaggagtgacgattatgaccaagaatcaggaatatgcactgcaatacgcagattatgcgatggcacagatgcgaaggtatggcatcccggcttccgtcacattggcgcaaggcatactggaaagcagcaacggacagagccgtctggcaaggaacgagaacaaccatttcggcatcaaggcaacttcctcgtggattgccgaaggcggcaaatacggaatctacaccgatgataagccgaatgaaaagttctgcagctatgacagcgtgggtgattcatacgagcatcattcccgctttttgaaggagaacagccgctatgccggttgcttcaaactctccccggacgattacaagggctgggcacaaagcattgagaaagccggttacgccacaggcggcaagtatgccgagaacctgcagaaaatcattgagcagaacggcttgcagaagtatgacagacaggtgatgcaggagatgacggcacaaggccggcagttcggggtggaacacaatccgctccagacttccgagagtgcggaacatggaacggggtattcgttcccggtggaacgggaggaatttctgttcattacctctccgttcggaacacggcaagacccgttggacagcacaaagcaacagatgcacaagggcgtggatatccgttgcaaagccgacgcggtactggctacggagagcggcggcaaggtcgtggcggtaaaccagaacaagaatacacccggcggcaagtcgctgacggtggaatatgctcggacggacggcagcaaggtacaatgtacctatatgcacctcaaggagatttccgtcaaggtcggcgatacggtacaggcaggcggacggcttggcacatcgggcaatacggggacacggacgaccggggaacatctgcatttcggtgtgaagaatatctatgccgacgggacgaaacgggatatagaccctgcggcgtatctggctgaaatcgcacagaaaggacatatcaaattgcaaatgctgcacaacggaaatgacctgctcgtcaaatacaaggcggcggaagataccgtgcctgaaaagaacctttcgccagacggatggatgaaaaaactcctttcgtcggaggatagcggtgtgggaatatcgggatgcaacgacccgattgtggagatggcgatgaccgctttcgcctccctgatgcttttagccacacagattgataaccgggaggaagaggaacagaagacggcgatatccgccgcgatggatcttcgtaccatcgacctgaagccgttgttgccgaatatgaagaactgcgacctgactatcggcgagaacggcaaggccattctgaaagcggacaacggggaactgcatgtctcgcgggagctgaccgcttccgagctgaaccggttgtctgccacgttgaacaacggtacactcacggaagaggccaaacagatgcgtgtaaccggtatgctgaatacggttatcctgtcggaagcggcctcacagaattttgagcaggggatgacccggcaacagggacaaacggaaaacctgcgaagataaaggcatggcgatatgataaaatgcgtgatgatacagctatgcaagtgtctggcgggagtttccctccttgcgttgcacctccggttctgctacctgctgttgggatggatcgggacgctcgttgtcgtgggcgtgcaattagccatcgccggatggatggtctgggcgatgatacgcgcacccgactgaccgcactctacaacagttcaacatcaatcaacccatgtatcacttgtccggatgatccatgtatcattaaagacaaaaaacagatgattaaatgtaatgttacggtatgcggcgttatcggccgcgatgcgtcggttcgcaagaataaagaagagaaagaatttctggtgtttccgctccgggtacagattccggcgacgggtggcgggcacactatcgaggtggatgtccgcaaggagggctgtcaggaggaagccgccggttatcggaacggctcccgtgtagaagtgaggggtacgatgtatctcaaacgccggggcgacaagctatatttcaacctgttcgccgatgaaatctgcaatgccgctacggatgatgcggattgcgtcaagggcgagctggtgtttcgtggtaaggtcggccagaacatcgaggaaaaaagggataagaaagaccagccttatacggtgttctcggcgtttagcgcagagaaggtcgatgacggcttcgagtaccagtgggtgcgcttcttctgtttcggtaaggagcgcgaagcgtggttgcagccgggtgtaaaggtggatgccaaaggtgaaatgaacctgtcggcacacaacgggaaaatcaacctttcctgcaagatggaggaactgacgcaatatgtggcggattcgtctaactataatcaataagggttatggccggttacagaaagaagaatgccgacggaccgaacagcgaggacaaggctcttgacctgttcgccgaaatgatgatcgagaaaatcgagggcattcaaaaggactggaaaaagccttggtttacggagggtacgctacagtggccccgcaaccttcacgggcgcgagtacaacgggatgaatgcttttatgctgcttttgcactgcgagaaagaagggtacaagattccccgtttctgcacgttcgattgtgttcagaagctcaataagcccggaaaggatggagaggaactgccgcgtgtctccgtgcttcgtggtgaaaaatcctttccggtcatgctcaccacgttcacttgtatccataaggagactaaggagaaaatcaagtatgacgattacaagaaactctccgatgacgaaaaggaacaatacaatgtctatccgaagatgcaggtgttccgggtcttcaatgtcgcgcaaactaacttgcaggaagcgagaccggagctgtggcaaaaactggagcgagaaaattcgcgtccggcaatcgaggagggcgagcatttcagttttgccccagtcgatacgatgataagggataacctgtggatttgtccgattacgccgaaatatcagaatgacgcctactattccatcacgaagaacgaaatcatcgtacccgaaaaggagcagttcaaatcgggagaatcgttctacgggacactgttccacgagatgacgcactccaccggagcggaaaacgtacttgacaggttcaagccgactactttcggttctcctgaatatgcccgtgaggaactggtggcagagttaggcagcgcactggtcgcacagcgttacggcatgaccaagcatatcaaggaggacagttgcgcgtatcttaaaggttggcttgatgagctgaaggaatcgccacagttcatcaagacaacgcttctggacgtgaaaagggcaacctcgatgattacccagaaggtggataagatagcgcaagaactggaacaaaatgtcggcgagaagcaggaaaacggagcggcagcaaaggagaatacattttattcttctgttgcgtatctccaattttcggatgacacgaggcagcttgacgaacttcgggagaaaggcgattacgagggattgctgacgcttgccaaggagtattacgacggcaatggcatcaacgaacagcatacttatttatcggccacgaacaacaagggtgacagccttattgccgaggatgagaatttcgctgtcgtgtacaacgggagtgtcgggggaacctacgaggtgatgttgaaattcacggagcaggaaatccgagaccatatccggcgttacggtgtcgatatcgccggagatacaataaaaggggttgccagggagatggcggcggaacagttctccgctttggcgtatcaaaagattccggccttcgagatgccgaacggtgaagtgctatatgtcgaatataacaaggaatccgatacgcttgatgtcgggcaacccaccaatgccgggctggtcgcgcagcatcgtttcccttacgaccacaatgtcgggctggatgccaatctgcaagccgtgaacgagaagctgaacgagctggaagagtatcgggcagaactacaagaggcagaatacggcagcggtatgcgccggtaaggatggaaagaaaaagatgcggaactggttggctccgcatcttttttgcagtttatttccccaacaaaccgtctatcatagactgtaaatttgctatgtcgcaatactggttacatccccctcggtagtcctttccattttgagctgtccgtatcagaaacgaatcgagttcaattcttacgccgctgcccattcgtgacagaccggaagagtggctgatgtaaacgaacttgccgttgcgctcaatgaagcaggaggtgtcataatgcccttttgaattggaagccacctttgcaccaacggctgcggcatatttggaaatctcacgcaccaatgctgtctggaaactgcggtactcttttgaaacatagtctcctgcatctgcaagtatagcgtcctgccatttggtataaaaattctgtgccatattgatatttattattattcgttccgcaaataacttttccatttctcgccgtcaatggtcagtttgcccatttcccaatcgtattccacttccggtatattggtataagggaaatgaacggtgtagcctatctgtccgtaagagcaatgcagaggggtaacgcaaatctcccaaccgaagtaagattgcggcgtgcagtattttcgccagttgaaacgacctgcggcaatattgccgcaaagtcgtttgagtatgtcgtttgttgtcattctgtacctcctttgctgagtatggtgagttgttcgggacggtctggaaaccaataagcatcactgtcgatatatacgcatctatagccattccaaggttttctgaaagctaatacttctttggggccaaataccaccccgtagtcgtttgtaaacgccaccatatcgcctacagccaaatcactgtctgtttccatgacttcggacaaccggctgaaaaactccatgccctcggcttcacgctctttcttccagcgcataaactcctctttgtggcttcttgatgagccaataggtaataactccgatgccaaaacctctgtctcggaagagcttgttgagattaagatgatgctgtcactatccactttttcgggagttgagataattcgacattctatatcattatcggcagtgtgccaaaaaaggaggttgccttgcttgatgaaatcgtacttgctcattgtcttttgatttattgttttttttatttcccttttcttgaagccttttgacttcgcccaaaggggttgttttcatgtgcgtcacaaacggggggatgcaagaacgatgagcaaggaacctgcaatgaaattttatgaaataccgtcatctccgattacggaaagttgtcgtcaaattttatttcaggtagcgatagcggtacttgggcaatgttcgtccaccgtacctttgcacacgaaaacagacctgcggcgtatgtcggggctgtgaagggattatacccttaaaacaggaatataccggctgtgaaaccggtggcggaagctctgcagagcatatttataaaagtaaccggggagcctgtgcaaaaaagagagcaaccacccacttttgaggcgggtggttgccaatgtttcggacaaacatcagaagtggtaatcaacaactcctccgatgtagagtatcgttcccggttcaagcctacaaacaaactccataaacgtaaaggactgttcggcaaaagactgcagccatcgccatccaaatagaaatgataggcgacatccaacggattttccactgcctgtttgagataataggtcgaaccccattccaacatattatctgccgtaagagcattcgctctttttttgatattggcgacatactcctctttccattgctctattccaccattatagcgcatggtgtcatcggatataagctcgaacattcctttgggcaaggcatgattgaccaaattggcaatatcctctttacggtcttcctcgtctatttctgaacaatagtcatagaagctcccgtctccttgctggagtgtgtcctcattcagatagttttctttgtctatcggctccgttgaaatttgaaaaatcctgctgtgcataattgtaaattttagattgtcaaatattttcttttttccttttcttgaaactcttttggcttctcgtcggggaatgatttttatgcaggactgacagcgggaaaaggacggataaggcaagtaaacagtgtacgggatgaaacggaatacccaaccgcccaatgtaagagcacagtcaggctcgtccgactatgccctgcaacgaggtggggagtgaaagtcaatcttcgatttgtggaaggctgccgtgaagaatatccgggaaccgttagtgaaagcgatacttgacgaccagacgcacgctgtacctttgcatataaaatctctccgaagagaattgccgacgtgagatgaaaagagaccataattgagaaacgctattattcataaggggaaaagactattcgtggttgttataaatgcttgattaacatgaaaatacaattcgcgccataaaataatcctttcttgaaataaaaatcacagaaaaagaaacaagattaaaaaataaccattaactttgcaccagtcaagtttccaatcgaagcgtcgaacggaattaaaagggaatcccggtgaaaatccggagctgtactcgcagctgtaagtcctattaaagtttatcgcactctttgccactggtgaaagctgggaaggcgcgataagcgggatgagccagaagacctgcttgatgagatagatttagtgaccacgggataattggcattagattaaaatgaacagaggctcgtccacaggcacctatattctttttgataaccgatttctcattcgttgcaaatctgtcgcaataaaaacgaatgtgtgtttaaactttttgtttaacttttaataattaagttatgaaaaagaattttagattcttggcaatggctgttgtagcaatggccgccgcagtgttcacgggatgttcatccgacgatgacttccttgctccgtatgaggagagtgcgattcaaacccgcgcgataagttctaccaatgcgcttatcgattttgataacgtaccttccagcgtaatggcttctgaccagtatggaaacaatctctattctgccacggccaacggcaagcaggtaacgaccggctacatcactcaaatcgggcaaaccggtacgtacattcagttcccgattaactatttggaacaagaatgggtaagcggacagccttgggaatatgaattttggaatggtggttttgccatctctaatttccataatctgacacagggggattatcaaaaccaatgtagcgtgtactggcccaacggcggtcatagcggtaaaaattttgctgtagctttcggttatagcgattcatacaatgattcacaagcaacctatgacaaatgtgcgaagatttacctgaccgatgcaaccggctacagagtcgttaccacaaacactcctgtcaagggtacaccgaaatatggtaaattcaacagcgtatgggtttgtaatacgacttatacctacttagtcatgaaggatggcaactcgtttacacaaggctctttgtcggcacaaaaaggatggtttaaggtggtatttgttgcgttggatgcgacgggtaaacctacaggtaaggaagtagaatactatttggcaaacttcgattccagtaaagatgcagaatcaggtttgaccaataaaatccgtaccggatggaatcaagtggatttaagcggtttaggtgacagcgtatgtactgtagctatcaatttcgaaggaagcgattcaagcgcatacggattgaacactcctgcttacgttgctatagacgatattgatgtaaccgtaaacgaataacatgaatttggggcaaatgctttttaacggcaagtgcaaagtatttgcccctttttattatatcccaatggagattggaatcaaatactttcttcaagggaatttcagcattaaaattataaatataatgaagaagtatttgcttttattctccttgacgatatttctatttgcatgcaacaaagacgaagaaatatcgcaggacgtgatattgcctcctgtcattgagttggatagcgaggacggaatctacgttgtaaagataggaaaagaggtcgttattgagccgacctatcagaatgtcgattacgccgtttattcatggaaatgcaacggtcgtatcatttccgacgagcctcaattgaaatacattttcaacgaatgcggttcgtattacgttaccctgcgtgtggatacgagggatgccagcacagaggaagaaattcgtgtggatgtcaatgaattggctccgcccgttatttcattggtaaccccctctatagggcttaaagttgtcgcaggacgtgagtatatccttacacccgacattcaaaatgcagaaggagctacttatttgtggactcttaacggaaacgaagtcggaacggaaaatacttatacattcaagcaagatgagttgggaacttatgaactgaccttaaccgtaacaaatgaagacggacaatcaaagaagacagtttctattgaggttgtcgataaacttccgattgaaatcgtagttccgtcatctttatattttaccgagaataataccaaatacgtagaattaggacgtactttgtttgtccgcccctttgtatcaataagtgccgagccttcttatcaatggagtttggacgggcaaccgattgagggagccaattctttggtttacggtttcaaacccgctaaaaccggagaacacacgcttacctttactgtgaaatacgacaatcaagatacaaaagcagtgctcacccgtaatatttcggtctccggtgtcgatgaagtcagtgtcaatattccggtgaaatgttgtgaagcggccggaaaaagaccttttgctgccggaaattccatttacagcaataaagtatatgaatttgttccggctccgggacaatttgtaaacgaaacgaatacagcaggtttcaatggggaaagcacgcacgaagcagcctgtgcttacgcacaaaaacgtcttgataatgaacaatatgtttctctcggaggttggggaggatatattgtagtaggattcgaccacagtatcgaaaacaaaggcggttatgatttttccatcaaaggaaatgcctttgattcgtcaaatgaaccgggcattgtatgggtaatgcaagatgtcaatggagacggcttgcccaacgatgaatggtatgaactgaagggttctgaatatggaaaacccgaaaccattcaggactatgccgtaacttatttccgtcccggtcccaacatggacacccaatggcaagacaacaagggaaataaaggggcgattgaccgtctcggcaactatcacccgcaagagttttattatcctttgtggattgaagaggattcctatacgttatacggcacatgcctgaaagcacgtaccgaacaaagcccgtcgacaggcatgtggtccaataatccgttcgggtggggatatgccgataatattggtgatgatatgcccaataaagacaatcctaacgcgggagcacttggaaactattttaagatttccgatgcgctcaatatcgacggcacgtctgcaaacctttcccatatcgactttatcaaggtgcagaccggagtcaatgtaaaagccggatggttaggggaaaattccacggaagttttcaagttctgtgatgaaaacaacaataacgacaaataaaattcattatgaacaaaatatatcatttcatcctattctgtttcgctacgctctgccttgctgcatgtagtgatgacgaccctgaagtaagcggaatagacggcaaggatcacttcatctccgagtttgctctaactgtagatggcattacctatcaagccatgatagtcggggacaagattacagttgagataccttataataccagtctgaaaggggctaccgtagagtatgccctttgcgagggagcctctattaacccgaatccatcgaccatagaggattgggagaatgaatggaaattcgtagttacctccaaaatgcaggatagcaaagtatattcctatacttatcaatatacagacatcgaacagagcggcagcgtagtacttgccacgcaagccgaggttgataattttgcaaagacaggaataaacaaaatcgaaggcagcctgaccatcggaacggcagacggagaagaaatcaccaatctggacggacttgccaacctgaaacaaatcagtaactcccttgtcatcaatccgtcttacaaaggaacggatttgaccgggttggataatctggaacaactcggaagtttcaaattaggttcgacaacttctgccagtaaaaacataatgctcaaaacggttaatctgccctctttgcttggagtgaccggtgattttgtcgttaacagttctgtcattgaaaaaatatctatacccaaagtcgagttcattggtgaggatatgtatataacttccgatgctttacttgatttggatgcaaatgccgttgaatctgtcggagcttccttaattgtcaaaggttcggtagcacaaaaagaatcagcgacaaccgaagccattgttttctcagcgctcaaacaggtcgggaatgaacttacaatccaatattttcccaaactgcaaggaatttatctaccggcattggaaagtgtggccggtactgcctcattctccgatatgtcctccatcggaagtcttgcaatgaccgaattacattcggttggaggactaactataaaaaattgcaaagaaatttccattgttgaacttcccggtcttatttcctgcggagagaccagtgtggatgcgaataaagtcaataaactcaatatagcttctttgaaagatgtactcggtgatatgactttaactaatctgctcatagaagaactggatttgtcccagataaattttaacggaaatacacttaccctacaatgtaagcaactaaataaaatcgtaggatcggaaacatttaacggtagcctttttctacttcctaaagattgtcgattgacagaatttacgttggaaggaatctcaaatatacagggtgacttccaatgcatagattatttttatgtaaaagaatttgttatgccatttattcgtgtggcaggagatatgactattgcattgaattcgggaagtgttaatacggcggcggaaatcgaatttcctaaattgcaggaaattggagggaccttaacattagggacaaataggaatgcaaataatattaccttcccgttattgaaaaaaattctcggttcatgttcagttacgacttacaaacttaagaatgatattgagtttaccaatctggaaagcattggaacggatggagctgatgcacaaattaagtttgagattgaggctactaatattctatgtcccaaattaaaaacgataaatgggaagtttgatattgcaacatcttcttttatgtttgatatggaagtagataaagtatcttatcctaacgtagaatcaatatccgaaaatctttcaataacatgcccgtattctgattttggttctaatggtattttgtccattgatttttcaggtctcaaatcagcaaaagggattagtataagcgggcaaggagatgttactgatttcagttctttcaaatacctgtttgaaaacaatgttctaacaggagaatctcaatggtctgtcaaagaatgtggttacaaccccactttccaagagatgaaagacgggaagtacaagcttgccgaatagataacgaaacaataaattttctgccaatcctcggtatgcttaccgtaaggtaagctgccggggattaactataaaaataacggtatgacctatcaccaattgaaatatctgctatggagcgtagttgtcggagtgacactatccttgacatcctgcatgaagtgggactacggcgatgccgtggaagatttcaacgccacgggagccggactgttcatcaccaacgagggcaacttccagtacggcaatgctaccttgtcctattacgacccggcaaccaaacaggtgcagaacgaaatcttcttccgtgccaacggcatgaaactcggcgacgtggcacagtcgatgaccatctacgacaacaagggctgggtcgtggtgaacaactcccacgtgattttcgccatcgacctgaacaccttcaaggaggtaggacgcatcgagaacctgacctcaccgcgctacattcatttcctaagcgacgaaaaagcatacgtcacccaattgtgggacaaccgcatcttcatcatcaacccgaagaaatacgaaattaccggctatattcaagtgccggacatgacgatggaaagcggctcgacggagcaaatggtgcagtacggcaaatacgtctattgcaactgctggagttaccagaaccgcatcatcaaaatcgacaccgaaaccgatcaagtagtcgatgaactgaaggtcggcatacaaccgacatcgctggtcatggacaagtacaacaaaatgtggacggtgaccgacggcggttatgagggcagcccctacggttacgaagccccgtcgctctaccgcatcgatgccgagaccttcaccgtggagaagcagttcaagttcaagttgggcgactggccctcggaggtgcagctcaatggcgacagggacaaactctactggatcaacaaggccatttggagcatggacgtgacagccagccatgtgccggtacgtccgttcctcgaatacagcggcacgatttattacggactgacggtaaaccccgccaacggagaagtgtacatcgccgatgccatcgattaccagcagcagggcatgatataccgctactcgcccgaagggaaattgatagatgaattttatgtcgggattatccccggtgcattttgttggaaatgaagaataaattgcggcatatataccatattattttcatcacgaaaagacaggagatgacgattccaatgacaaccaaaggaatgattctcgatcagatggtacaaattttcacaaggaaaggctgtcatgtctatgcctgcaatgcttttctcaatcatgttcatatacttgtagagataccatctcccacggacttcgcaaagattatcaataaagtaaaaagttctacaggcgttgtctatcgaaaatatccggaatatgcggatttttcaggatgggcagccggatttgattcgtttagcgtgtcattcaatgatctgaatcgggtaaaacaccacattgagaaacaagagacggttcatcaggaactttcattcgaggacgaatacgaccaactgcttgaagaaaacggattcaatgcctatcaagattttatgcgggcatcattctctgcatatgctgcggtaaataaccatattaaaaacaaaaggaaatgacatatacaaaatatttacttttctcaatattggttgtctgtccatccgtgctgtctgcgcagggaatcacccggcgtattcaccagatagacgaggtgaccgtatggggcaaacggccgatgaaggaaatcggcgtgcagaagacgaagttcgattcactcgcactgaaagaaaatatcgccctctcgatggcggacatcctgacgttcaactcgtccgtgtttgtcaagagctacggccgcgccacgctctcgaccgtcgccttccgaggcacgtcgcccagccatacgcaggtgacgtggaacgggatgcgcatcaacaaccccatgctcggcatgaccgacttctccaccattccgtcctacttcatcgaccaggcatcgctgctgcacggtacttcatcggtgaacgaaacgggcggtggactgggcggtctggtcaaactcggcacggctcctgaagtcgctgaagggttcaacgcccagtacgtgcagggcatcggctcgttcaagaccttcgatgagttcgcccgcttcacctacggaagtgagcggtggcacgtctccacccgtgcggtctattcttcctcgcctaacgattacaagtacaccaaccacgacaaaaagataaacatctacgacgaggataagaacatcgtcggacagtatcacccgaaagagcgcaaccgctccggggcgttcaaggacctgcatttgcttcaggaagtgtattacaataccgggaaaggcgaccgtttcgggctgaacgcctggtatatcaactccaaccgggaacttccgatgttgacgaccgactatggagatgcaaccgacttcgagaaccgccagcgagaacagacgttccgcagcgtcttgtcctgggatcacatgaaaagcaactggaaactcggcgtgaaaggcggttacatacacacatggatggcctacgactacaagcgtgaggtcgcacctgacaactgggcgtcgatgacccgctcccgcagcaaggtaaacacgttttacggtcaggcggagggagagtattctttggataaaaaatggtttttcaccgccaatgtatcggcacaccagcatttggtacggagcgaggacaagaacatcatcttgcaggacggtggcaaggccatcgtgggctatgacaaggggcgcgtggaactctccggctccgtatccgccaagtggcagccgatagaccgcttgggtatgtcggtggtactgcgggaagagatgtatggttccgattggattccactcattccggctttcttcattgacggtatcatttccccgaaaggaaatgtgatgctgaaagcatccatatcgcgtaactaccgtttcccaactctgaacgacctatactttttgccgggaggtaatcccaacctgaaaaacgaacaaggtttcagttatgatgccggggtgagtttcgatgtcggcaagaaaggcatttacaagttgagcggcggtgcgaactggttcgactcctacatcgacgactggattatctggctgcccaccaccaagggcttcttctcgccccgcaacgtaaagaaggtccacgcctacggcgtcgaggtcaaagcgaacttcgccgtgcagccggcgaaagattggctcatcgacttgaacgggtcctattcgtggacaccctccatcaatgaaggtgagaagatgtcgcctgctgaccagtcagtgggcaagcagttaccctacgtgccgaagcactccgcatcgctgaccggacggttgtcgtggcggacttgggcgttcctttacaaatgggcgttctactcggaacgttacaccatgtcgagcaacgactatacgctgacaggacacctgcccgaatatttcatgagcaatgtctcgttggagaaaaacctgtttttcaaaccggtggacatccagttaaaattcgccgtcaacaacctcttcaacgaggactacctttcggtactctcgcgccccatgcccggcatcaacttcgagttcttcatcggcattaccccgaagttcgggaaaaacaagaaaaagtccgaaaatacaaatatgtaacgatatgaaagcattaaagaatttaagcctgctgttgctacttgtattagcattcacaggctgccacaataaaagttcaaaactcgccgatttcaaccgaacggtctatacacctgaatacgcttcggggtttgacataaaaggtgcagacggcaaaaagagcgtattggttaccgtcacgaacccttggcagggcgccgacagcatcactacgaacctgttcattgcccgtgatgacgaagaggttccggcggatttcaccggtcagatgctcaagggggatgccgagcgcatcgtctgcatgtcctcgacccatatcgccatgctcgacgcaatcggcgaaacgggacgcgtagtcggcgtgtcaggcatcgactacatctccaatcccgacattcaggcacggcgggacagcgttggagatgtgggctacgaagggaacatcaattacgaactgctgctctcgcttgaccccgacctcgtgttgctttacggcgtgaacggggcaagctcgatggagggtaagctcaaagagttggatatcccgttcatgtatgtcggcgattacctcgaagagtctccgctgggcaaagccgaatggctggtggcactttcggaggttatcggaaaacgggcggagggcgaaaaagtattcgcggaaatccccgtcagatacaatgtcctgaaaaagaaagtagcggacaatatcctcgacgctccgtcagtcatgctcaacacgccttacggcgacagctggttcatgccctcgaccgaaagctatgtcgcccggttaatcaaagatgccggaggcgattacatctacaagaagaacacaggaaacgcttccgcgcccatcgacctcgaagaggcgtatctgctggcctcgcaagccgatatgtggctgcatgtggggatggcgaacacgcttgatgaactgaaagccgcatgcccgaagttcatcgacacccgctgtttccgtggtggacaggtctataacaacaacgcccgcaccaatgctgctggcggcaacgactactatgagtcggcggtcgtaaatcccgacctcgtgctgcgagacctcgtgaagatattccaccccgaactggtcgaggaagatttcgtctattacaagcaactgaaatagatgcgctcccgttccgccatattgtttgccatgctggccgccctcacccttttcctgtttctgctggatttggcggtgggggcagtcgccgtaccgctcggcgatgtatgggcggctttgacgggcggcgactgcccgcgggcgacggcgaaaattatactgaatatccgactgattaaggcggtggtcgcgttgctggccggagcagctctgtcggtcagcggtcttcagatgcaaaccctcttccgcaatcctcttgccggcccctacgtgctcggcatcagttcgggcgcgagcctcggcgtggcactcgtcgtgcttgcaggcttcggttcgtcgataggcattgccggggcggcttggctcggagcggcgctcgtgctggtcgtcatcgccgccgtcggccaccgcatcaaggacatcatggtgattctgattctcggcatgatgttctcgtcgggagtcggcgcgattgtacagatattgcaatatctcagcaaggaagaatccctgaaagcctttgtcatttggacgatggggtcgctcggcgacgtgaccttcgaccagcttgcggtactcgtcccgtcgattatcgccggactgttgttggcggtggtgacgatcaagccgctcaacttactgctgttcggcgaggagtatgccgtgacgatggggctgaacatccgacgctcgcgcgggctgctgttcctctccacgacgctgcttgctggtacggtgaccgccttttgcggtccgataggcttcatcggactggccatgccccacgtcacgagaatgctgttccgcaacagcgaccatcgggtactcgtaccgggaaccgttctttcgggtgcggcggtgctgcttctttgcgacctcgtttctaaaatgttcaccctgccgatcaacgccatcaccgcattgctgggaatccccatcgtggtgtgggtggtcttgcgcaataaatccgtcaccgcatgataaagttacacgatttttccataggctacggcgagcgcaccttgctctgcgaggtggaaaccaccatagaaaagggcaggctgactgcccttatcgggcgcaacggcacgggcaaatcgacactgcttcgagccatcgccggactgaaccgccgttataccggccgaatcctgctcgacgggcataacgccgccgatatgcgagcagcagaaatggccagaacgctggcattcgtcacgaccgagcgcacacgcatcgccaatctcaaatgcaaggatgtcgtggctatcggccgcgcaccctataccaactggattggaaagatgcaggaggtcgacaaggagatcgtcatgcggtcgctcgcctcggtgggcatggaggcttatgcggagcgcacgatggacaagatgtcggacggcgagtgccagcgcatcatgatcgcacgggcgttggcgcaggatacgccgattatcctgctcgacgaacccacctcgtttctcgatatgcccaaccgctacgaattgtgtacactgctggcacggctggcgcatgaagaaaacaagtgcatccttttttccacgcacgagctggatatcgccctctcgcttgccgatgcgatagcccttatcgacccaccccagttgtcgtatatgccgaccgaagagatgcgccggagcggctgcatcgagcggctgttccgaaataattgtgtgacgttcgatgccacgacaggattcataaaagtgggacaatgactaaggaatatatcatagagaatttcacagcaaatatcagcgtggacgaatatatttcacgcttccgggacgaaaaacgttttgtcgaattttgcaaacaatgccccaactacggtaatagttggggatgcccgccgttcgatttcgataccggagaatttctgcgccaatatgaatatgcccacctgatggccacgaaaataattccggtcgagaaaaatattccgatagacagaacgcaggaattgattaaaccggaacggctcaggatagaaagggaattgctggaaatggagcacagatacggaggtcgggcattcgcctatgtaggaaaatgcctatactgtcccgattccgaatgcgcccgcaaatgcaaccgtccttgcctgcatccggacaaagtacgtccctcgcttgaagcattcgggttcgatatgacacgaacactctcggaacttttcgggatagagctgctttggggaaaggatggtattctaccggaatatcttgtgattgtaagcggattatttcataattcggcagaaaatattatcagtcatacgaagcgtaatcaggattcaggaaacctataatcttattaccctcattgataacaaaagtccctgcaatccgaattatagattgagggactcgatgaaagtgaatgtaaaaactaaaagaacaactctactttcgtatgcctgttgacttcgaccggtacatggtcggctatgccgcctctgcttaccttgacgatgcgttcgatcggtatgccacgctttttcaattctgcaacgatataatccgctctcgatgtacttaatgaaccattaagcacaggagttccagtcgaactgtcggccgcaccggttactctcaaggataatccgtatttcttggccacgcgagccagttcatcaaggttaagcatttgggaagcatccgtcaggtgcgccgtattgaggttaaaaaagaaatagacaggcgacccgatgcaattcccggcttgtatgagttccgtcctttcagagacgattatgcccggtttctcggcatcatctccgttgttgccatatccaatacttgcagaatcaagcggcgagattccatcccaatgccggtttttcaatcttgcccgtagtgagttcaatccgctgtaattatttctgggataaccttgacggcggtcggtctcatcgtcattaaccagatgaccgtacttgtcaagcaatccttctatttccagaattttcttcaattctgcgaccgtccgtcggttgcggtcgtaccagtctttataacgcttgttttctccggataagatattggcatgatccacgagccactcattctgacgaatgtaagatgtcgcatcaaccgcgcgtttccaaccgacctttccgagatgaaacgtgaaaccggcggtcagcgataccatgtggtcgccgaggcggttcgggcgtccgtaaccatcgaagtcctgaaaggtggtcgtgccggagagttccaacatggcacttactcgtttggaaatccgatattctccctgtacgccatacgaaacagtaaagggattattcccgttagaggcattgtgcaacaggccgacaccggcaaagggagcaagattccagcgtacctgttcttgccgggcatatctgcagccaaggacattccacagcagatccgcatggatatggtggtagtcctgattggacaatgttccatctttgaactgcacaccgctgtaattgatacgtgcgccgacggacggagtgaaccattttccgactgcgaaactgtacgagggtttcaagcgtccgaagaggtcttcgcagccgagaggtgtgccgagaaaggcggacgtacccccggcaatactgacaaaccagttgccagtcagggatgccggaagtaccactccgtcaagatagacgggctgtatcggttgcagttcctccgagacattatagtacggtgtatgttgtacagtatccacctgtacgggttgtatacttgcctgtgcctgcaacgtgcaaagcacggccaatataaaaaagatttgtttcgtcatattccaatgatattattcgttatactttttgatttgtcatgagacgtatgccacttaccgtttgggtttcttgccaatggccggacgcatcatgcggctcgccatcctcatgctgcggagtgcccatgcacggttgtcctcgtcctcatcgcgcccccatttcaggtcgctgccgccacctccgccgccacgagtttcggcaaaagtggtggcatcatcgaccataccgagaaacagcatcgtcgcgcagtgcatcacgtctgtaccttgttccgctatggactggacgagcgagccgtcgaacagttgccgttccgccacgtccatctgtgccgatacgttcctatactcgccgaccacattttccagcaggacatccttgagcaacgtgtccactttggaatgtatatcatgggagtatttgtaggcttcctccttgagttccccggtacgttcctcaatggcatccatgttctctttcagctcggcaagctgccggtcagccgtctgtaacttctcctgcttgtctgccagttgcctgttgatgcctgccagctctttctccagacttttaacttgtgcggctaattgttccgcatcgcccttgttcgctttcaaatcctgttcggctgccgatagcagagcctctttttcggctttcgacttctcaaggttatcgaccattgtcgtaagccccttgaccctgcgctctgccagacggatgtccgattggaggtcagccagaactttttgatgacggctgatattttcctcgatggtcgtacattcttccgatagcatacggcggtattcttcggtagtcctgtgccgtgcgcctgtttcggatatgcttgttcctctcgacattccccaccttgtattgacttcggcgaaaaagtcggtatgaagctgtttcatccttgcgctgtattcaaacttgtcctttccggcgaatatttccttgtacgcaaagcggccgtctttgattggcaacaaagtacaatgcacatgagggttcaattcgtcaaggtgtacgatgaatgcggcgatgttctgctcgccatatttgccactcacgaatgaatagacgtctttcgcccagcgttcaatatcgctttctcttttgatatggatattgtccgcatctttctcgaaatccactttctgcgtgccgaatgcgagttcgtgcatccgcttacgggaaccgccgaaaatgaagttcaccaccgtgcggtacttcggttctgccagtccttcgttggggtctttgattccacgcctctccaatatgtccgccatccgttcgggaatgttgcggctcgtgtcgatgggacgtaccttgcctccgggtgcaatctcgaagttcaggtgtttgcgtgtggggtcgtaattccccttattcatagcgtacttttccgccctttcactgcgatcacgcaagtgttcgttactttgggctgtggtgatgcctttcgacacctgcatatcaagtacctgtttttgatctgccatactcttttcgtgttgtttggacaatccgtcctgtcccagcttgctgcttgcccggacagcctaccgacggtcggagacctatcggggtattaggctcccccttccctttgtttcgtggcagacgggcaagcccgtgtgcctcctataaccggcaggataaccgttaagggatggaggtggattgttcgcgttatacaatctgttttcgactcccggttcaatccaccatcgcctgtgcctttgccagaagcgataaaaaaggtttgcgaagcgatttgaggcgttcttggtcttcgtccatgtcgaagtccgtcactgatgcctcggtgtcgagaatcagcccggcgaggtctttggcggactcgatgaaagcagcccattcttcaccgaggtcaaaccggaagaaatccacaagcggcgaactgtcatcgaatctcgacttgtgcaggattttttgcagggcggcgtgggcgatgcagcacaaggctgtttcacgatgttccgtgaccaaagtgccggaatgtgcggaggtcgtgatggaatgggtgtccgaacagtgtccggcgtcacggtcggcaatttcagcctttgccagacttacgagttgtccacacattacgccagtttcggcagcggtcgttttgccgattacccaatcggacaatacctcacggagctgtctggcaaagtccggctgctcctgtgcatcgcggggctgtgctgcctgaccggattgtacggtcatggtaatgaccacgcttttgggaagctggatgcgggtcagcaaaccgaatgcctccattgcactcaaaaaagaacggacggtagccctgtgccaatgccactccgatgcgaggtcggaaacggtcaggtggcactggttgggttgcagcacgtaggccttctttcttaaaaacggagaaacgaaacctgccagtgatttgtccaacaggtcacagtacgcttcggtgcgtgttttgcgttcatcccctttctccttgagatattcgaatacctccctgtctgccaatatggaaacaggtatcttttggttatttttcattttcattcggttttaatgattcatattgtgcggatatatcagtgttgccgctgtccgcttcatgcggcagatttgcgtgatgattctcgtgataggattctgacaacattccgggatgctttgcccatccggaaagtgtgtccgtatccttgcattcggacatgacccgaacggagggatagaacagggctgccagaagaagataggcaatggttatcgccaaggtgtacagatgcggcacaaagccgatgaccagtgcgcccgatgcgagtgtgacaaatgcacgggggcggtcaagcaacctgcgtaaccagttgtccgtccgtcggaacgaaaacattgcggcacagacaccggtagagagtaggattccaaactcacccatatgtccacaggcatatacataatggaaaagaagcaggcatatcagccatacttgcacatacagtttacgggcgttgccgcttcgtgccattgccatgtaaaagggtgtcatgaaccgcttgttgttcttgtacaatgacattgataccccgaaaggtatcgcgcagaaaatgagtagcaggatattcagtaacataagtaatagggcttttcgggtatgggagtgggacgcacaatgagttccaactggacaataccgtatgtcgccagccggataagggtttcggcatccttgggcgaaaagtacatggccgctttcttgatgcgctgcttgaatgtaatgtcttgctttcggtagatggccaaagccttgtccagttcgtgttcgggaatagtccatgtcgtaccctcggcgtgtatgccgttcgtcttgaaggcacgcagtaccaatgtacgggaaacgaggtagtcggtgcggtcggttcttgagatgatatgctccttgtagagattgtcatcggcaacctctatccacgtccggtaggcattgatgcaatagaccatctgtcggtataaggtgtttctcatataaaattcatcagcacgtcggacttgtctttcttgtatttcaggaacccgcttttggagtgtagttccaagtcgaggcataagtccccgtacatctgctccaaagaatcatagatggtgacaaggatgctgtttacattgccctccgtatccgtcttggcgttcatcttgaacatctgtccgaaagcgggattcgagtatgcacaagtgctgtgaccgaatttttccgtccgcatcggaatatggtggtagagcgtgatcaactccatgtcgtcctcgaacatatccattacttcgtccagttcgtaaggggtgcgcaacggaaacgtaagcagcacatagtcgccgtagaactgcggttcttccatcgtcgtcacatcgagcaactgcggaagttgcagggggacgaatgccatgaagtcattataaaaatgtcgtaacatattcatatctttttctgttgttatattttacagcgtgtgtatgaatgcctccatcagcattccgggcagctcgtccaagcggttgtctccggggtgcagcatcctgcccaactccctgaaagcgtcgggtgtctgcgaggcaagcatatcgagttgctctctttcttcggctgaaagcaacgccaggcagaaaccgtccaacgacgaataaggctggagaagcatccagatgtaggcttgtgcctgtgccggtgtcttgacttttttattgcagatgtcgtcgatacaggttcggatattctgaatcagcctgcggttggtgcgcatggccagataaatcatggcattgcgataggtgatgtcgttccgttcggcggcaaggaatatctgtgcacagcatcgttccgtgtcatgagtgatgtcggaaagattctcgccgtcgaaatcaggcagacgtgaaaggaatgcccggtacacggcatcctccttttcgataaaggtcgtcaggtctgccatacaatgaataccgtaatcaatcgtttcagcaagggtagttcgataagtggcaagaatgtgttgtcggtttctctgactgacgggccggttatccaatgaggcaaagaacggtcggattgtttcagccgcacgatgcaactctttgtcttcaagatgcggtgagatttgttcttttacccacagtatatccttataagtgcgtgtttgagacagcaccatccgtgaaaattccatgcggatggaatcatgtatctgttcacactcttctcttacagtggaatgaagccggccaagcgtatcacattcgagatgcaggaatacggaatccctcaatgtttgccattgcttgaggtgtccggccaattctttaatggagagttttttctgcctgcgtatgtcggacaggtattccctgtatgttccggcagggtcattcttggctttcgccaatcgtttgccattgccgttgtcgcatgacgcgcataggaatatggcaatcgaaacggcaattattttggcaaagattatcggctgttttaagttcgattttaatgttttcatactatatcatttcgtactatttagtgcaaaactatatattatttttgatacttcgcatccgaaaaaccgtattttgtgcattttttaatatcgtacttaatagtatgattaccaatgaaaacaagtgaagataaaacacgtggaaatgtacgattttcgttttttaatatagtatgattcatatactcgaataaaacttgtatatttgcacttgttatcatgaatattgtatattgatatggcaaaagtcggttatatattcgaggctaattcctacgatgcgtttgatgcggataaggaatggatgcgccaatatgggtgtgtacaggtggttgaagaatcggtcggacacgagacgcttaggccgagatggaaacaactgatgtcgaatcttgaaagaggagacgaattggtgatgtcaaaattcagcaatgccgttcgtggtttacgggaactatcggcattgattgagctatgccgcatcaaggtcgtgcgtattatctccattcacgataaaattgacaccgacaacaaattgtttccggacacgacaccggcggaagtattggccatgttcggggcattaccggaggaagtggctgttttgcggaagtcgtcggataaaattatacgcctgcagcagagtatcagtattccgatttccaaaaaaagtatgagtaaaactgaacgggacaaaaaaatcgtggatatgtataacaatgggtattcaatccgtgatatttggaaagaaagcggtgtccaaagtaaaagcaccgtgtacagcattctcaataaatacaaggttcagcttaaccgaacaccgggacgagtgccgggcatccggaaatagaacttataaatcaatatggatattgaaaatcaatagattgcttgcgtaattcatcgttttttcgtatctttaagttggatataactatataaaaacaagacctatgggagatattataattttattgctggtgttcttggtagtgggcaggcttttgaggggcgtgttcggaggattcagcaaaagcagttttcgggatgacaaataactccggattgttgtaactggcagatatttgttaattttgcaccgtattcataaaaatcaagaacaatatgacaaaagcggaaattgtcgctcagatctcacggcagagcggaatagagaaaacggtggtgatgactgtgatagaatcattcatggaaaatgtaaaagagtcgatggttgcgggaaacgaggtgttcttgcgcgggttcggtagctttatcatcaaacggagagctgaaaagacggcccggaacatttcgaagaatacgacaattaaaattcccgctcacaatatccctgcattcaaacctgccaaagcatttctgaatgcggtaaaagagaacaagtagagtataaaagtacagatggtgcaacaacaccgtaatgagtaaaacaaaagcgacccgaaggccgcttttgtcgtgataaggcaaggattatttcttgccttttttcgctggtttggccggcttttcaggagtttcctccttctcgacgggcggatagaacttgacggcgaccatcacgatacggttgtgtttcacaccgctttggtcgctccattcttcgggcttgaaatacccctcgacggtcagcatcgtacccttggtcagttggtcgaacgacccggtgttctcgtttttacgccacgcctcaaaattcataaaggcggaaacgcgtttggattcctcgccattattctccaatcggcttactgccagagggaaacgtgctacacttgcgttggtgaactgacggatttctgcatcctttcctacgaaaccggttactacgaaattgttttcaatctttttcataatgaattgtttttagaagttattaaatcaattttacgctgcctcaaaaagtaggtgcagttaaggggatgcaccaaggccggacgcatcaatactctttatttttgtccgtaggcaaaaccggaaggctcgataaaggaagattgtacggctgcgccattggtcaagacttccaaagtcgttcccgtctgcatactatctttgcatcggaaaatgatgatgacttcggcggaaaactattctgaaaatgagcggaaaaccgtagttgcaggggaagtgaaagtgcaatccgtccaccggcacaatggtgcgcgtttcggctgtaagtccgcagaatcggcaggtattttcgtgtaattcggtcggactgaattgaggtggctacaaacagaacactgaactgacaacaggttgcggtaccgcagaagggaatatcaacgaagtggcgacaaaaggcggaacggggtatcggggtactgccatgttcccgtccggcagaaagaaaaggggacaaaagggaaaaaggaaagaaccctgcttttcggaaaagcggacggagcttttcacgaatggctgttttttacaaaaggatatggcgcagccaaaagagagagatagatgtaaaaaagggaatgcggcgtggcaggaatggaagattatcccgttcctgcctgcctgtatcatcaaaattctgccatgattacccgatgctcgaaaatctttttttgattactgggacgtctttggcaaacccataggtgatgcttgccatagccgaagacgaaataatcatcaaggcgtgttttttcttgtaggcgttccatgccggtacgcagttccgcttcatcggttgagaaaagaatcgtgttgatgatacggaagtagagttctgttacctcgtcacaataaggacaaaagctatgctcaatcgttgctttcatgtttctttgattttaattctacttctactatgtcttctattcgaccatacaggacagagcgcaacgctgttttgtcaatggcgtaatactcggcgatatgtccgtgctgttttacgaaatatcgtttgagaacatcggagaaatcaaagaagtagcccatcaatgcgatacctcttttgaaatggatgcactctttcacgtttcgggtaatccagttcttgtcttcacggctcaacttgtctccgttatcaagttgttcccgtaactggtaaaccctgctgtctttcagcttctctaattcgggtacgtcccattggacgaatttcattgctatctgctgcatcgctcttgtatttaatcgtaaataatcacttcatcacgatactcgaccacctctttgccactactaagacgcaccactattttattgccgaagtcgccgacaactgttccctcagagtagcctttatagggggtaagcaaggtgcagtgcgcacctataatttcgctattttcttcgtattcgtacataagtcatgtcattttacggttacaacttgatatcccatttcccctgtgagaagattctgaagctcacgtattcgtctgtaaattcgtaggacagaattttgatataagttttgtctttggcttccaacgaagctatcagtctgtcgatttcttcttccggataaacccaacgagaggtaaactccgcatccacgctatcgctgtgtctattgacaaagccgtcgaaagtgtcatccaagaatgcctctatcttgtcgaggtctgctttgttttccgtccttgcgtagaaaatgtttgttgcatagtttgccataatcctaagttttaagttttttattttccctcttttagcatttcagctactttcgggcttgattgaaaattatgtcgcctcaaaaggtgttatggctctttatgcagggtttcacgaccaaatacgacctctgcaaagcggagcgtggagattttgtcgggaaccgtcaggctgtgaccttgaatacaagaaagacatgacaagtacctttgcgacacaattctcatcaggcagaccgaaagttgggatgcgaggatagaatgcctatggcagaagttacgataaaaggaacttccgtaaaattgggatgcagcgaaaaaagaaaatatcggtgcgattatcttctcttttgactgtgaatataaaagtaagggggagaacttcggtaaaggtttagtttagtctattagcttatatatatgctaaactaaagtaaactaaatataggcagatatattggactgcctgtataggtgttttgagggaaatggttacctttgcaaaaaacaatgttccttgaaagaaacagagatttgtccttttttcttttggctgtagttattcatccatagatgactgcaacaatcactcttggcgagaggatgaaaatcgtgtgaaaagacttggaaaaatactcaaagtacgaacaagtgaagagaaagaaaggtagtgcaaacaaaaaaacaagaaaataagataattcgtgtttctgttcctaatttgtttcttgataaaaacacatcacaatataaactattaatttacaagatattatgatgtgaaattttgagatataactaaatttgccaggttgatctgctcttcatctccgaagtcctgtggcatgtaggaggtgcaggagttaccctcattgaccggcttataaggcgggtcaaaataaaatagggagttggctccggtgtattctgcggtctgccggtagtcaccgtccagaatcacaacatcttgcagcagcttgtggttaaagcggatcagttcctcttccaacagttttacccgtcccccggcaccaaaagtgacggacagctttccgctatggttcacggagtagatgccgttataacaggtacgcatgaagaagataaacagggcggcacgggtgatgttattcgggtttccttcattgtagtaggtacgtttctccatgaagtagacccttcttcgggtatgttcctccagcgcgatgtattcgtcctgtatccgggcaagcactttaataagctgctccggggattccttgatgacgcggtagacattgatcagagcctcgttggagtcgttgatgacgcaacggatttccggataggcttgtcttattcagaagaagagggcgccgccaccgacaaacggttctacataggtatccatctgtccgaagtctttcggaagggattcgataagtacgggaagcagtcttcttttacctcccacccaggggaagcagggttttcccggcaggttggccggagaacttttctttttttccatgtttacaacatttaaatgattaataaattaaatagggattattcatcgtctgccgtttccagcaggtgtttcaagttgggatcattttggatgcgaagcagctctttttcgatgatttgcgtcacgtcttccttgatttgatagtagttcctttcgatttcctcttgcatgtggtccttaccatccgcaccggtaaagtcggttatgacggggataggcttgtaggcttttgtttcggcggctacccgttcattgtccaccacgatctcgcaatggaatatcttctgttctatcttctccccgaagttgtcgcagacactgccgacaaactctccttgcgagaggttggagattttggaggcaggtatcagcgagtcgagctgggtactgatattggttgaggtgtcttcacgggtcatattaatggatttgcgctgttggagcactttcccaaacctttcagaaaggtttttcgctgtttctccgaccacttgcccggaaaagatatttccaattgtgttctggatcacccgcgcctccttatcaccgtagtcacgtattaactggctgaaatcctgtgctcccagacatactgccactttgttgctacgggcggtagcgatcagggtgtcaagtcctttaaagtaaagtgtgggaacctcatccactagaatagagcatttgagcctgccttttcggttgaccattttaacgatacgggcattatacaatcctaacgcacatgagtaaatattctgtctgtcagggttattgccgacgcacaaaactttgggttcctccggattattgatatccagcgtgaagtcatctccggtcataatccaatataaggcaggtgagatcagccttgatagcggaattttggcggaagctatctgcccttggagctgctccatcgcaccacctttccatgcatccataaaaggtgacaggtaattctccagctcccggtaagaggtcagtatggtgaacaggtcggaatacggtttattcaatagctctatggcatgtgggaaggtgcagaatttcccgttttcatagattttaagataccagatcaccgccgcaaatagcacaatcgggctttctacaaagaaatctccctgcttttgaatccaactcttgttcaaatttaacatgattacatacgctgattcgtatgcatccgcgatatcggatagaaacgaaggattgaggggattgcaccggtggctgtatctgggatcatcgaaattaatcacataaaatccgaccggcttggcatacttatccttgtttttaagcagctggttataagcaattatgcttaaatccggatacttaaaatcatagatataggcggcgaatcctttctctatctgctggcggatatagttattgatgatggcataactctttcctgatcccggcgtgcctaatatcaatgaggcgcggaagggattaatcacgtttatccagcctgaataggtctttcgttggtaacggaaacgggtgggcaggtttaccgagtattcattggcaatcaacctgcgctcctgcatgaagctctcgttctcgtcgttaaagacgtcatccatgagttggttcttcaacaggcggctgatccaggttccggcggtaagcaggctgatatatccggcagctacggtagctacatataataaggttagaagcgcgacggggaagcgtgccgtcagtaagagctcgctaccaaaaaagagcagcatcccggctataaggtaacagccgatactccttcatgacatctccacgtccttccgtcctttcgctcccatgcaggagaagaaaaggaagagcagactgaaggacttgctcaccagcgaatgggaaaacagcccggtatcccgctggaaattgagcagtatcttgtccacgacaccgatgttcaggttcatggaaagaaaatagggatagcagaaataatagacattcatcactaaaaataggatgctgatggccctcatgaagtcaaggttcttattgagccctctggtttcgtcttgtgacataagcggtatgataattaatggtgatacattttattagcccagatgcggacctctgcgttttctctttttctttttcccgtaagggctttgcgtcaggtcgtctgccggatacggataggattccaaagagaatatatcaagcagtccttccaccagctccgtctctttcatttccggttcggacggatggataacaggggcttcttcagtcttttccggtgggatcgtgccgtacttccggtttataaccgatgccgaatattctttgcccagaagcgagcccttgaatacggtctttgagttatggtcgatgtaggtcacgccatagatcacaccggaatcgttctgccagagtatggcggcaatgccttttccagaaagttcctgcaggaatccctgacgggtgggctgtccttgcagggcggtagcgatagcttccttcgtctgtacgggtacgggatgtcgggcaattcattgtttgcttttcacaaatttcttttggagtgcctcgtagcctacgcttttaccgatcttgctggatttgatggctacgccggtccgttctcctttttcatcggtagccgcatagaccagtccatgataggtctttccctttatcgtcttgtgggcctcttccaccgttacatggaaaaggccaagcagggctttaaactccttgacggattggaacttgtatccctgcatgacgggcttgaccacattggctatctgatgcttgatatcccccttccggtaatcgacggcagtcagcggcagggattcccgtcgctccatcttctcggcgggtaacagatggtatttcctctccagctcccggcaaacagcggtcgagcgttgccattctttgtaatctttaattttctttccctgctcgtcaatacgcagggagacgatatggatgtggggcctgccgatatcctcatgccggtagatgatatagggttggttgccatatcccattttttccatgtattcctggccgatagcggtcaactgttcatcggtcagcacatcgtccgggtgtggatttaatgaaatgtggataacgggcttctcagtccggcggttagccgccagatacggttcgaaggaacggatgcagtgctggatggtcggatggccgtctgccggttccatgatccggtttcatgccagtggccgtgcctgctgcttgtccactttttcttgattgtagtataatgccccgtaaacggaggctcctgatgttatttttgcaaccattgttcaaattcttgggtgagacggataatctcccggttgagagatattagttcaatagtcagttgctccaatttatagagcatggcaagagccttcttttcggatagtccggtatgcagagctttgactgcctggttatagtttactccgatccggcggtattcgctctgcaggttggtcagcttgatgtagtagtccgttgccgccttatctattttcacgactttcatcggtttgtcgaaaagggcggcaaggatgaactgggatttattattagctcccgaattctcaaagagcctctcaaactcgatgttctggagttcgtccagacggaatccgtaataataagaatgaagttctgattcctctttgggattccgtccgcctcttcatttgctcgaagtgtcagcccgtccgggtttgcgtgtactattgattttagccatatcttttcaggttttatttatccggcagcaaaataagtgataattttgatacgaacctaaaatcggaaagtgactacaaatgacaagagatgactatttgtgacagggggtaaaaatacccctgttcacttcccgtttccgcaagccgcgatgttcttttcaaaggtttcctttagtttgggcagcaggacggaatagttctttttgcgccgggcaaggtcggcacgcaggtcatatggtttgggaatggcaacattgaagagtttctcaaaagcggaaacgataccggcgaaagagaggcgtttgccgctttcgtccgtaatcagcccgctgtaatccagcgaggagatcagttccatcaggttgaccagcgaacctttccaatggagcgatgaaagaaacgaggaaggtgtcgtgatggttccggggtactgtacaccaaaattgaccagctctatttccgcctccaccagcaggaggcatttgtccagatagaattcggctactgccgtgtggaaatgtcctgttcgggtgaataacttctttagggaaatcagttctaccttgctgtgaagcagatggcgcagcctttccgatacggaaaccgattcgatggcgaggtcgtaaaggtattgttcatattcggtataggaggaagagaattcttcatcggaaactgtctgttttgggcttgaagccagagataaataattgaatatacggcattctgtaaatggtttcatacggcatacatttgatttgtttataccggagtaagccaaatgaaatgcctctgctatcgtttaaagctctatacctttttaaaatactgacaatcaacaataaacaaatttcatatagaaacgggtgtaaataaaaagtgtaagccgtccttgacaagaatgttaggacggcttacacttttgtaaacctcatttgcttcgggttatcctccggtcagtcgatgatatggtatttccttagtttctcatacagggtagtccggctgacattgagcaaccgggccgccttggaacggttgtcacccgtcttttcaagggtctggagaagcaacgccttttctttttcttcttccgtccactgcgtttcttcttctttaggaagggagatttcaaggttcaggtctgaaacggaaatccattgctcttggcagatgagtacggctcgacctattacattcttcagttcacggatattccccggccagggatattccagcagtgccgcctctgccagccggtcaaagccacgaaacgatttatgggccttggcgcaagtgagtttcaagaaaaaataagccagaggaaggatgtcttcccggcattctgccagtgtaggaatccgcagagtgaactcattgagccggtggaacaggtcttcccggaagcgtccttctccgatggctttttccagattctcattggtggcggcaaccagccggatatcaaaagagtattctttcgtggaacctaccggcttgcagcgtttctcttgcaaggccctgagcaggagcatctgtgtcttataggaaaggttgcctatctcgtccagaaacaatgtccctccgttaacggcacggaacaatccgaccttgtcgctttccgcaccggtaaaggctcccttctgatgaccgaaaaactcggaggcggcaagctcatcggaaatggccccgcagtcgatagccagatacggcttgttcttccgatggctccgggcatgtatctcggctgcaatgtgctccttcccggtgccggaagccccacggagcagaacggagatgtcggcacaggcaatcatctctatcagacggtacatctcatgggctttggggctttcacctcggtagaactcctgttcgttatcgtttttatccagtatctccgttatcagagccaggagattgtctggctgcacaggcttacacaggtagttgatggctcccagttgcatggttgtcaccgcattctccacctgtccgtagttggtcatgatcagaaaagggatagagtagtacttctcattcatccatttcaggagcgaggtgctatttccgtccggcaggcgcaggtctgccagtattaggtcgaactccttttgcccgatggctttacgggcattcgcaagggttgccacgcattcggttttcatcccttttttcaccagccagttgctgatgctacggctgaacacaatatcatcttcaataatcaggattgttttcataggctttcctcccgtatttttcagcgtatactatcagtttttccactgcccggatgatgtcccgcatttccatggattgtctattggtccactctgtcgcaggttctgtcaccagttcccgtaaatgagacaaggggaaatccagacggacggtttcccataggggcaggttcttatgcaggatggaggcggcggcctccttgtcttgtcggtctaaggcagcggttaatgcggcaaggtctttccggctctcttcgataaacagggcgagcatttcctccctgttgtcctctcctgaaaggatgagtgagaaatcgggagcatactcctttctgtctttttctcctatcacttgtgccactgtatttatcagttcttccatagagaatggtttatggatgcagcccgaaaagccgcccgacagatactcgttgtcatcatccacccgtgccgttaccgctatgacggggattgtctttgcgttctccatattggatgcccggagcagttcaagtattccgtagccgtccgtttcaggcatctgtatatccgtcagcagcaggtcatatctttgtgaccgtagccgggtaaccagttcacggctggtctggcagcagtcgcaccgcactccgttacggttaaacatctctttggtaatgttcagttgcatccggtcgtcatcaatgaccagtacgttgattccatccagatgataatcagtagcgatgcgtgtctcatccatctgggtggattcatccgcctcaaggagtggcaggaatgcggtaaacgtgctgccttcacccggtttgctttttacggtaaggcttccctgcatcccggagaccagcctgcttgcaatggccagccccaatccgaaaccgggaacattacgggcattgtccaaccgttcaaaagctgtgaatatccgggttgtttcttcctccgtcatcccggtaccggtgtcctgtaccgagaaatgcaattctttattccggtattccgcttgcaggcggatttcaccttgccgggtgaatttaatggcgttggaaagcagattgttcaggatttgctggagctgggaacggtcaccgcttactaccacatccagaccggaaaaggcggttgtcagccgcagctttttctttttggccagcgaaccgtagttccgggctgtttcgctgaaaagggtctccagccggaaaatcgaaaggatgggtttgttcctgccggtatccagcaggtagaatccgatcagcgtattgaccagcccgatcatgtaatcggaagaatggagtatattttccgcatactcgtccttgcggctcttcttttcttccccggggagcagttcggcgcatcctttgatagtagccagtggcgcacgaaggtcatgagcgatggtgagcatcatgcgttttctggattgtaggagctccgtgttctcacgattggaggcttccagctgacgctgatactggtttatcctgttcagatcccggtggatgataagatacaggaggacggtcagcaacgagatgaggacagccagcagagagaccgtatggaacgagcggtcgcgtgtggaaatgaattgcctgtaacgctcatcaagccgtattccagcatccgcctcaaagtccctgacaatccggtgtagcctgtggttcaggtccgtgttgttactgtacaggaggtccatctgttccagcagcctttcccgttcggctttctgcatgtcggtcacctccctgtcaagggagtgcagcatgctcgtgacagatgtggtaccctgatgtttaccaatggactgtcgctggcgttccagctgttccttctgctgcagataggccgattttttcctcccgggcctgatgaatgaccagaaacccttcttcggagtttcctcctccttctttttctcggcaggaaggacatccgcctgctggatatgggacacgattgccggaatcttgctgttcacgatctcgccggtcttgcgcagacgcccgaacgtgtccatgaccgtgtctaacaacagttcctttctttccagcagcaggcataacgaatctatgcgcgactgttgttcgggagacttcacataccttttcagtgtctgcaacatgttacagacactgtctttttttgtgtggtagagtccaaggtcgctttcatcccagacgctgactgtttcaccgtaagtggccagtcccagcaagcccgcgtatgtttctccggccagatgccggatacaggccagttcatgctcatcctgtcgcaggctgttccgcctcgtctgttccttgcggaagatatgaatggtcaggacgagcaggagaagcagtatgacatatcctaaaaggattttaagtttcaaccacatggaagtcttcattcttatattggaatcctacaaaaaggcgtgttcgctcatataaaagggaataatagaaacttatgataaaagtttattactgtttcaaaccatttgaggatacctcgcaagtttgctatcacacagttgatcttttaatctttttttatactcacagaaaggataggaacctgctttttatgactgaaacatatcacatcccctttattggacattacattctcattcgatcatattgttttcatttcggctcatccgtttcttcacccgttctactgcttccgatacaatttctttgttttcaaagcgttgtgtataattggtatagtctggatgaatccgtttgtaggtcgggtcaagaaacaaaggactggaaataatatggtccgctgtcgaacggttacaacagaaaactatattttcaactcccgccagccgggtcagtgcctttacatccgtgtcatgtggctgcaatgtcatcggatccgtgaaaaagaacaaataatcaatctctccttccacaatacgtgagcccatttgctggtcaccacctaaaggaccggatttcagaatcgtgatatcccattctgtttcaggatgtttctcttcgagcgcttttttaatgagtgtaccggtggttcccgtacaatagaacttatgccctatcagacgttccgagttccaaagaacccattctatcatgtcctttttcattgcatcgtgtgcaaccagaccgattttacgaacaattgttttcatcataataataaaatatggtttatgtgataatataattaacaatatccaacagctttataaaaaacaggagaatgactgtatgagtttgagcagctccttgttcgcccggctgtccacggtggcttcccgcctctcctcaaacaaagtaagcgttgcggagcattccccgcagatatcaatgccgactacacgttcctttcgaaggacaattgccagtaattcctccagttcctgcaggctgaaagacccttgatcccagtctgttactgcggatgccgggttcaggacatccttgtctatggacaagtaaaccggtccttcaatatacgcagaggagaaattgcgccagcccttctcgtgagctaacgtcgcttcgctataaaaactgactcgttgtccgtattcttccggtacggtgcgtatcagtttgtccgatgcaccgactatcaccactttcttgcaaagcatattccagtctaacatgtcttttacccagctcccacaagaaagcatgcccttgaacaagggaggctgcatgtcggggtgatggtcgaatacaatcagagagaacggaactcgaagtttgtctgtccataatttggtcaggtaatgataattgcccgaatcaatgaaatggataccttccgctggataaccggcaatcacccgcttcaattttcgtatcccctccttgtcacagtaacctctcgttccagaaaggtgacggcagtctagccaaatgaactgattgttccgtgcaaatacctcatgggcatacacaccggtgaagttcatgatgacaaccggccagacggtttctcggtccgccttcttcttacaccgtccatttgtcagtaactcttgcttattcatgtccgttcagaaccatcgtacataacaaaaatcttgccggtgaggtaacaggggatggttgggatacattctgaatgcctgtttgaagcttccagcgctgaacattctggttattgccttgaaagtgtataggtttccgtctttggatgtcaaagaaaaaggaatgacctcatggatgcgatcctcattctcctcatgccgtataatgaccgattccaatccgatcgcgttgtccagccctttctcgtcaatgacgaccgtcatctcgtattccttaccagcctccaccgtggcgtccaatccttttcccgcattcacggaaacgatttccacggcattccatctgctgtcgacagctgccttccagccggcaagcgttttcgcctttgcataattgtccgccgccaaaacatgaaagtgttccgacaacttgttgtaaaatccgtcatagtagtcatccagctgtcttttcatcgtgaagcggggagctatttgcgcaaccgagttcttgatgtacttgacccaggtttccggatagtctttttctttccgttcataatataacggcaggatattatgttccagcaggaaataaattgtttccgcatccagttggttctggtactgttcatcctgataggtggccttgtcggtgatggcccatcccgcctccttgcggtagccttcgtaccaccaaccgtccagcacggagaagttgagtacgccgttcatcagagccttctcaccggaagttccggaagcctccgcaagacgggtgggagtattcatccagatgtcaaccccagaaataagatgccgtgccaggtccatgtcataattctcaaggaagatgattttacccaagaattcaggacggcgggatatctccacaatctgcttgatgagcccttgcccggcagtgtcgtttggatgggcttttcctgcaaagacaaactgtatgggatgttcctgattgttcacaatccgcgccagacgatccaaatcggtaaacaaaagatgagctcttttgtaagttgcaaagcgccttccgaagccgacaagaagagcattcggattaaacttctcgaaaatggagacacccaatgccgggtcaacctggcttttgagccagtcccggccgcatttccacttgatgtaggatatcagtttggttttcaaccttttccgcatgttccatatctcttcatcgggtatattataaacgcctttccatatttcctgattggactggtcgttcatgaaattctcatcgaaattgtccttaaacagctttttccactccgccgtacaccaagtgggaaagtgtacgccattcgtcacatagcccacatggttctcttccgggaaatagcctttccagagaggcgcgaacatctgctgtgaaacggacttgtgcagcttgctgacaccgtttaccgcctggctggttttgcaggcgaataccgacatgcagaaacgttctcccttgttgcccggagtttgccgtccgaggttcatcaactcgtcccacgtaatgcccagcttatcaggatatcctttcatatatttattgaaaagcccctcatcgaaatagtcatggccggcaggcacaggtgtatgcacagtgtaaagcgaggaagccctaaccagttccatggcttgtccgaagtccaggccttcggatatatagtcgcataaccgctggatattgatcagtgcggcatgcccctcgttgcagtgatatacatctttctcgatgcccaatacttttaatgtcatcattcctccgatgccgagcagtatttcctgcttgagccggttttcccagtcaccgccatacaggtgatgggtaatcggacggtcgaactcgctgttcagttcattgtccgtatccagcaggtagagggaaacacgtcccacattggccttccatacattggcatggaccgtgaaactgtcggcatagggaacatggattaccagttgtcgcccgtcaggctgcatcactttctctatcggaagctgcccgaaattctgtgggtcataatgaacctgttgctgcccgtccatcgccagagcctggtcaaaatagccataacgatataaaagccctacagcgcagaggtctacgttactgtccgaagcttccttcagatagtcacctgccaatatgcccagaccgccggaatagattttaagaaccctgtccagaccatattccatgctgaaataggcaactgacggacggctgtggtccggctccacatcaagatacgccttaaaagtggaatatacgttttccatcttacgcatgaagtttccgtcatgtgtcagtgcctccagctcttcataatccatccgttccagaaacagtaccggattctgttccgcctcttcccatagttccgggttcaaaccactatataaactcttcgcatcctcgttccaggtccaccaaagattatgtgccatctccgcaaatctccgcaattctgccggaaggtgtgaaccgactgtaatctccctccattgtgggacgtttacatgataacttgaatattccataacattttacttatttgatagttcatgatttttttctgtggaggtttctcctgtttccggttcttcctgtggaaatgtcccggctgtaccctggaaattctcgaggaactgtttttccatacttagcgatcgtttccgtatccgcttggaaaaatagataacgacaatgatcaggaaagataatatcagtcctgaccccaaagcgacattgaaaagacggatgatgatacccattacgataatgatacagatcaacaccttgatcactatcattgataccagcagccccctgttgaacctgttgtccgcccaaagtttgcggaattcgacggaattgtttttcttcatgatgatggcgcacaaaaacggggatatgataaggaggacaagaacgaagctcagcaggcttcctttcatccccggaatacgtcccattaccagaggatacgcataggagaagaacagcgctatgaaaaacaggcataccaccagataaagggtgacggataccaacatggacctgatgagcttgtgccaggagccttgatgtcttgtggtcattgttccagaagaataatgcgtcaggtaatctttcaggaattgtggcaagtgcctgtctgcaaaacagtagacgggatccgacagtcttatcatataaggagtaaggaaagtggtgatgaccgatactgccactatgaccggataaaggtatttgtccattacattcagactgattcctaacgaagcgatgatgaacgcaaactcacccacttgtgccagggaaaagccggcttgtatcgcaatctttagcggttgtccggaaagcaacacgccgaaactcccgaacaggacctgcccgcataggaccagtgccgtcaggataaaaacaggaacggcatattcccatatcatggcagggtcgatcatcattcccactgatacgaagaaaacggaggcgaacaggtcctttaccggttgcacgatatgtgcgatttcttccgctttatctgtttctgccagcagggatcccatgacgaacgcacccagcgcggcggagaatcccgcctttgtcgctatcatcaccattcccaggcatagtcccagggaggttgtcaacagtatttcattgctaataaagcggttcaatcttttcagaagggtaggaatcagatagattcccaatgctgaccagaaaataagaaaggccgcaagtttcaatatgctctccagcatttcgaagccttcaaaatgcttgcctacagccaatgtggagaggaccaccatcatgattaccgccaccacgtcctcaatgattagtatccccaggacaataccggtaaatttctgatcgagaagccccatgtcactgaatgctttgaatacgatggcggtggaggacatggacagcattccgcccagaaagatacagctcgtgtgtgagaagcccatcgcattgcctgccgtatatcccaggaacatcatgccgcagacgatgataacagtggagaatatggccgaggctcccacacttatcagctttctgaacgagaaatccagtcctatggcgaacaggaggaaaataacaccgatatccgcccatatcttgatattggcctggtcggaaacagtcgggaatagggaaatggaaggacctgccataataccggccacaatatatcccactatgaccggctgtcccagccatttgaaaatgacggttatgataccggctataatcaagatagtggcaaggtctgatattaaaggggcaacttccgacataggagtaacattttatatggacaactcgttaaggacacggatcaggtttttgtcaatgggcttgtcgttcttgatagcctggtcaaaaggaacatagacaatctcattgttatgtatgcctaccatgatattgtgctggtcctccatcagggcctgtatggcggcctcacccagccggctggccaatatgcggtcgttggcacttggcgctcctccccgttgtagatgtcccaggatagagaccctgacatcatatccggggtattccctttttacccggtcggcatagtgcatggctccgccattcttattgcccgggctttccgtcacgatgacgatgctgctgttcttggtcttccggaatccgcgtccgataaaagtctccagctgatccgcatccgtccggtcttccggaataatggcggcctcggctcccgaggctattgcgctgttctgggcgaggaaaccggcgtcgcgtcccatcacctcgacaaagaaaattcggtcgtgcgaggtggctgtatcccggattttgtccacacactccacaatggtgttcagggccgtatcatatccgattgtaaaatcggtaccgtacaggtcattgtcgatggtaccgggcagtcctatgcacgtgacagggtattcctcggcaaatatgcgggctccagtcagtgagccgtcgcccccgatgactaccagcgccccgattttttctttcctcatggtatcgtatgcctctctgcgtccttccggggtggtgaacgcttcggaacgtgccgttttcaggatggttcccccacgctggatgatgctgctcacatcctcggtcgtaagttccctggactcgcccgctatcaggccttcgtaccctctgtaaattcctttgactttgaagccgttgaaaatggcggtacgggtcacggcacggattgccgcattcattccggaagcgtcccctccggaagtaaggattcctatatattcatcttttttcatctatctcagttcttgttttgtttcattctgccaatatagctttcagttttttccggcagtgaaaaatacggctctttatggttcccaaactcacaccggttctttccgctatctcacggtatttgaaccctgacaggtacatctcaaaaggtatgaaatgcgactccggtatacttttgatggcattacgtatcttttccaggtcatagttcctgtccacctcctctgtacgggactcgtccatgatccgcgaataatatgcaggatcggaggatatgtacagacgggtatgaccgacctccgcccggtaaccgttgataaacgtgttacgcatgatgataaacagccaccctttgaaatttgtgttcttgttgtaactttctttgtgaagcattgccttgagcagggtatcctgcagcagatcttccgccttctccctgtccgctgtcagtttgtacgcgaaacggaacagttcgtcctgtacgctaagcagctctttttcaaaattgaattccttcatcggttgtgccggttccctgttccggaagtgcctgttaaaggccggacggctctccggacaggaaaagcctgtccggccttacaccattccagatatggaattatttaacctcgatagccttggaagttttttgtttttcttcctccttcactttcgggatttcaatggacaggatcccgtgttcgacttttgcggaaatcttatccttctccacgttttcaggtagcaggatggtctgctggaacttggaataagagaattcgcggcggagatacttcttgtctttcttctcctccttcttctcttctttcttttccatgcagattgtcaggttgttgttttcgtcaacattcaccttgaaatcatccttcgtcattccgggagccgccatttcaaccttgtagtccttgtcattctcaatgacattgatggcaggagccgtaactcccgtttttgccagccactcattctcgaagaaatcgttaaaaatactcggcaaccagtttgaatttgtttttacaggtaccatttttacctccttttttaaattgttaataaataaaatattcaaaaagacaatacaaatcagtctgattgactgactcttatcgtctgatcataccttgttcggctacagcctccgtccgtctccgtatctcctcctggtctccgaggaaatagtccctgacaagcaccggccgttcatcaaattcgaatacataaggtactgccgtgggcaggttcaagagggatatgtccgtatcggaaatattcttgagatgcttgactatcccgcgcagactgtttccatgggcaacgacaagcaggttgtccctatgcatcaatgtgggtaggatgacacattcccaatagggcatgacacgcatgacggcatccttcagggattcagtccgtggcagttccatttcgggaacaccggcgtaacgggtgtcgttccccggatagcggggatcgtcttccttcaccggctcgggcgacacgccgtaacttctccgccagatatggacttgttcctcgccatatttgtctgctgtctcccttttgttaagtccctgaagtatgccgtagtgtttctcgttcaacctccagcttttctccaccgggatccagtcttcattgagacggtccagaacacaattcaacgttttcacagcccgtttcagataggatgtgtaagccgcctcaaaagagaatcccgcttctttcagcatatcaccggctttacaggcttctgcgatccccttatcactcaggtctacatcggtccaaccggtaaagcggttttccttgttccataggctctcgccatgtctcaacaatacgatccttttcatgccatatagtttttatgcaacggttatcgaaggatccagatagacatcctgaatggtgttcagaagcgagaccccgtctttcatcgtcttctggaaggcttttctcccacagataagtcccatacctccggcacgtttgttcaccactgcggttacgacggcatcatgcaggtcagatgtcccatgggactcgccccccgaattgatcaggccaacccttcccatatacccgttggccacctggtagcggcagaggtctatcggatggtcggagaccagttccgtatacatacgcccgtcggtcttaccgaatccgatggctttaaaacctccattgttggacggcagcttctgcttcacgatatcagccttgatggtgaccccgatatggttggcctgccctgtcagatctgctgccgcatgatagtcaatcccgtctttcttaaaactgctgtttctcagataacaccacaataccgtggccatccccaactcatgggcatattcaaacgcctgtgagacctccacaatctggcggcggctttgttccgaaccgaaatagatagttgcccccacggcaacggcacccatgttccatgcctccttcactgtaccgaacatgacctggtcataactgttcggataagtcagcagctcgttatggttcaacttcacgatgaaaggaatcttatgggcgtacttacgtgccacagctcccagaactccgaatgtggatgccacggcgttgcatcctccctcgatagcgagtttcacaatgttcccgggatcgaagtaaagaggattgggtgcaaaggatgctccggcagaatgttctatcccctgatccaccggcaggatggagacatacccggtattggccagacgcccgtgcccgtacagggcttgcaggctctccaaggtgcgtatattcctgtcggaatccacccatgccttgtctatcatattcggctcggggatatggatgagtttcttgtctattgtcttgcatacatggtccaggtagtatcctgcctgcgttcccaacaaatcaataatcgtgctcatgtcagtcgtttttttattccaaatcaggactggcgttcccccagttttgcatccatgaaaaggatgccgctctctccggctttcttcatcaggtttacgatgttcaggaaattcgcctcttcctccacctgctccctgacaaatccccaaagaaaatcacgggtggcattgtctttctcctcggaagccagatgtaccagttcgtcaatcaatctggaaacatgtctctcgtgttccaaggcatgttcaaagacttcggtgggactgccccaaccctgtggaaccacatcgaccttgtccacttttgcctccgcctcacgtttggccatatattcggcgatggcacatgcgtgtcctgtctcttccgccgattgcttgcgcatccagcgggccatgccggaaaaaccttccttttccagatagaaggacattgaaagatacaggttggcggaccataattccgcagtaatctgcccgttcagggccttttgtaaattctcggtcataatgaatctaatttttaatgttggtactattttttatttttcatattcaggggcaagcgtgtgcttgtctcaaaatatctgtcaggacaggttgcatcccgtttatgaaacattccacggcgatgaccatcagaataagccccatcagtctcatcatcacattatttccggtttctccaagaattttcaaaagccgcgttgacacgcaaaggataatgaaagagaggagacagactagggcgatcacgcaaaccagtgcaattttgaaaatatgctcaggggcatcttccatcagtgttatgccgcttgaaattacacccggaccgcacagcatcggaacggcaagaggcgtgacggtgatgttcctggaatattcttttttctcgttctcgttcagtttcacatgggtgaagtgtgcctgcagcatgtcatatccgattttaaagatgatgatacctcccgcaatccggaaaccattggtcgagatcccgaaaaaatggaacaggaacctgccgcacaaggtgaaaagtaccagtatgacgaacgtgagggcgcaggattttaaggcgatgctccggcgttctccggcactcatgccctcggtcatctgcaggaaaaccggcatcactccgagggggtccatcaatgtgaacaacgaagtgaaacacaacattgagtatgcgaatatatccataggatgatacttgttttatttttagaccattattttctctgtgaacaataaactccggtcaggttacacgatttgacacatcatatgaagcagggcagcctgcgttcatattccatggccaggatacgcaacaattccataaacgccgtacttacatatatccgttttgtgtacagccccttgatgaaagaatggatggatgaatccgtattctggcatagtacgtgaagttcggatatctgacgggatatatattgttcatgttcaagcagggtgttcaaggcagccagcggtgtcggccattgccggatgtcgcgcctgatttcatggatggttacagcacctccttcatgatagatgcggttcatcatctgatagaccttgcccatattgtcctgtgcctgtgcacttagccatgaggccaatatcagaagttgctgcccctcaaaatagacctgcaatgacaggtacaggttagttgaccagatttctgtattgatcaatgtgttcatcgcatattcaattcgtttatccatggctgttctgatatttgaaattagacaaaataaatcgtaattcatatcctgcaataatcatgaatttatgtgatagcatctgtaaatcggactcttatggagttgtaaaatgaattttaatgcttgcgagacaaatagtcataaaaatgtataattatcatgcctttttgtcacaagatccctacaacattctcaacaagatatccagttctttctctatcatgttgatcttgtcgtatatgtaatccagcgtattatgatagtgcaggtaggccctgcattcctgcaattcccttgacagggagagtatttgttgccaaagttcctcttctgtatgtccagggggattattgaatgccataaatggattcagagaaactgtttggcatgtaatttgtgtaataatagccgcaagtcccgaaaaggggcaggaatggaaacaaaaaggcagagaattccactaaagacagtaacagacagaggaatgaaaacggaaggcaggacctgtccggttttgaaacaaattgctttcataatgcgattatatgacaactctgttccctgaagttgtgtttatataaagttaagcgtgggaactttggtattaccgttcagaagtatccccatactcaacaacatataatacacaaagccccacgcctatatatgctaacaagatataatagtgcatagggacacctgatgtattatccaattgttgtcttgaaattggggatttcctgaacatggataatgcctaacgcttactgttattaatcttttttggtaaaagacaaggcaaaaatactaaaagaattgattcgcgtcaataaaaatccaacttttttattattttactctctgcgccactgaatttcatcgctctccgctctccaaatcccgtgcccttcagcgataagtaatcctgagttcatcaattgcctcataaaagagcttttgtacatcctaaaatccgcaacctgtaatatttttgatatctggggttgcagatacctctctaaaacgactcgttttcgtaaagaaccctaatggtgcagtcgcaagagacaaaatccccttaccccatgatgcgacttgaggcaatacgcaaaaggccacgaagatttgaggctacccaaaatcaaatttgaaggccatcatgtatgcatcattgcttgtgtatatgttcagtatgtgctgtcttgcagtcttaatccattttgcagggacagaaacatacttgaatacaaaagttttgattctgcttgtgcgtttaagtccaaagctcttcatgtttgcgtcagatatgaggtgtctgtaaaagtttcgtattaaagcggtcagaagcaggaacaccgtgttttccgccatgaacgattttggcagccgtttccagccaaagccgttgttcatgtcgtccaatacacgctcagcaccgccacgcttgttgtaatactccacgatgtcacggtctgtcgaagtatagtcatttgtcagtatgcatctgtatgtatattccccttcccacaggtcgagttccttgttgatgcttctttgccgctgtatgacaaggcggtacgctttgccgacccatttctctgcaatgatggagcatatctcaaactcgtgaccgtttatgtattcggtcttccatccgcgcaaggcaaagatatcgtcatacaacgatacacacctgtttgcgcggatataaaaatgccgactgtgcttctccaccatttccaccatagcctcagagcatgagccacaatccatcctcgcacggtttatatgtattctggcattctccaaacgctcaaaaatacgttttagagtgtcttcctgatggaaacggacattggtattgccgtcgcggttctctatcccgacgatgacatcgccgaccgttgctattcctggactgtaaccggtaaacttcttgtaggtcatttttgcgtcaaatttctccgtctcaatgaactggtggtcaaaatcaaagtcatattcattgtctggcagcaactgtccagttgccagcaatgcattgacaagcagattgttaaggtcggaagccacgttgaagtcgtagcttttgcccgaatcagacctgtaggtcagattcggtgtggtcaattcacgaatggccctaagtattgtgtctgcgctgcatgtacggaggggtggatgcaagcaaagtgcttccataaggtgtgaggtcacgtcttcgacacatgaccctccacagaaatatacgcacatcagagaacgtattatctcgctatattgatagccatacactttgctacgcaaacctaaagtagagtctattgtacaagacaacatcctgtcgaatttctccataattggaaatataccaccaaaagatgtgagtttctcggattttatttgtacttttaccatgcttgatgaggttttgtttgactatttttgcaacactaagttaagtgaatcctttgacatgacaaaatcctgagccgctcggctttgccgcttggcttgtccaagaactttttgttgttcaggatattataaaagttaaaatttatagtgttgcggaattaaggtaataacaatactatgaaatcgttattcatattacaacttgtatgttgcgtcattacagccatgctagcattgcaattagccatggcaagtttgcaggtgagatggaaggtgtggcgctacgaaatatcaagatggattctcgttgcatccatgctattcttctccgtccactacctcttacagatgattcatggactccgtgcacaaggtaccgatgtgggcgcagcattcaacatattgttctatactccagtggcatttgccatcactctctccataatcaacatagagagcacaggcaacaaagtgcgacggtattgtttacgtggtatgatggcatacatactcatcgccatagttttcgtcattggcatgttcaaaagtcaaagtttacacattggcaatatgctctatgtgatgctcggtctttttgtggctagcatggcatattttattcttatcattcgcaaagaaacaaaagcccgaaagcagaagctcatggagaatttcggaatcgacttgattccatacgtgcgctattcgcaagccagcatcattttgctatactttgctgctggactccttcctgtagcaatcctcttcaataccttattatatataataggtcccttgatattactctctgtcatctttttcgtccacactttcattgctatgggctattacatcacacccaaagaagtcattcctgaggaaaatgacgcagaagcaaaagtcacggaagcagaagacatgaaagacggcaagaacactcatggcacaaatatcttgacagctaatagaaagatggaaatagaattagccctcaagaaatggtgtgaagagggattttataaggactatgaagttaacatctattcgctagctaccaagttgggatacaagaaaaacgaactgacagaatacttcaatcagtcagaatacaccaattttagaacctggcttagcgacattcgttttaatgaggctgttcgcatgatgaaagccaaccccgaatatagcattgacgctatttccacagagtgcggtttctcatcccacacatggatttatcgtatattcaaacaaaaaacgggcatgtcacctagccaatggcgcaaacagtttgcctccatctaaatgcgtatttttgtaatttcgcattaaatagcatttaaaagaggtgtgtcagcgttttgacacaacctctacttaaaagatttaatttacaatagtattgcggaattaaggtacatgaaaccgataacctgtcatagtggcattgggaaaagccgttcagacgatccgcatcatggtcggcaaaagatctaaagtgacctctttggctgtcttgcgcttggagacatgaatcatttcaagcacctttatgacgtcttcagacttcgtgccacgtatcatggtcacaagtgtacctctgccaccacgtcccgcacgattagtgacaacagtatataattctccgcagcttaaagaagtctcgtcaatacaaaggctagggacctgaggttgtgcccgcattctgacacatttacatttgtagtattaaatatcccaataaaaatataagtgtatattgtaatgggatcttaatagaggattaaaaaataaatacttaatgggctgtttcttatgaattctactgaaatcttataataattgctcaaaaaatcacattctttgtatacgtaatatcctaattttggaacgcaaattaaaagaatattaataaactaaattatctgatttatatgacaaaattaagatgtatgctttgttgcctgatgatctgtactattactattgatgctaggactgttaatgatatatataaaagaatatctgcacaagtctccttgaaggttcccggtaatcaatcacgaaactattcccttgcttttcaaggagccgttgatgataagggaatctatctgttagagtctgaagaaaaaataccattaatcattacagagagaatagaacgtgacaatgttaaatgtgtaatggtagtaagtattacggcattggaagacgtgtactttaattatcaacaacagttgaaaacaggcttccgacataatgactgtatgttttatctaccaggattctggtatagtcgcaatttacgttctcctaaaggtgctccttcatttcatatatcagagagttggctggtacgtgaggatcgtctgagctcaccccttaccggtatcttcaatcagaaagatggacgttatatgactgtggcacgcaaggacgattttcaatgggatgcccttgctacccaccaaacaggcgaaatcatcctctcgggcaaaacgtccctagggttcaccggctttgagagccatgacggaacatcaacactatcttttggatttccttaccgagaagctcctaaaacctatattcgtaagttgacgctggctccggaggttacatctttccaatatctaaaaaaaggagaaacagtactcctgacctgggaatttatcgaggggcaggctacagactactcagattttatttgccatacttgggaatattgttatgatacataccgtccccaacctgtgaaaatacctttttctccagaagagataaaaggagtgctgagcaattattttgtggaaagttttgttggggacaaagctcttgcctattactccagccctgaaatgaaagtggcagcctgtgccaacatgaatgtagcagagataggttttgtcggtcgcgtacttctaaacgctttcaatgcatgggagtttggcaatgagaatggacgtgatgaccttgcagctagcagtaaaaagatatttgatagttacttagaaaatggctttacggaaaccggttatttgcgtgaatgggtaaatctggaaaatgatagtgatgtgaaagaagaacgcccagtgcatagcatacgtcgtcagtcggaaggaatttatgccatgtttcattatctgaattatgaacagaagtataaacgtcaccatcctgattgggaacaacgcttaaagaaaatgctcgatatgttcttgcaactgcaaaatccagatggaagttttccacgtaaattccatgatgactttacagttgttgacggaagtggaggaagtactccatccgctacattacctctggttatgggatataaatattttaaggacaaacgctatctgtccgctgcccggcgtactgcggaatatctggaaaaagagcttatatcaaaggctgactatttctcctctacgctggatgcaaactgtgaggataaggaagcttccctctataccgctacggcaacttactatttatcattgataacaaatggtacggaacataaccactatgcctctctgacacgaaaagcggcttattttgccttgtcctggtattacgtctgggacgttccgtttgctcccgggcagatgttgggtgatatcggtctgaaaactcgcggctggggaaatgtctcggtggagaataatcatattgatgtatttatttttgaatttgccgatgtgctccgttggctttccaaagagtataatgaacctcgtttctctgattttgctgaagtcatttctacttccatgtgccagttacttccttataaaggacatatgtgtggagtgataaaagttggttattatccggaagtgatccagcacaccaactgggattatggaaggaatggaaaaggatattataatgacatgtttgctcccggttggacggtagcatccctttgggaattgctgacaccgggacgtactgagaatatactgttgaaatagctctgatatccacttttcaggatattcttatatcctgttgtatgttaattaatgaaactaacaattaagacaatgcagagactacgtattttagttatattaatacttctttctttgatgcctctttattcccttgccgttctgaatgaaggacaatatgcattccgttcacttgatatcaataatggattatcccagaatacggtccatgccatccttcaggataaacaaggatttatgtggtttgggacgaaggatggtcttgaccggtatgatggtatctcttttcggactttcatgaaagaatccggaaccttgggcaataatttcatcacttctttgtatgaagacaatcttgggcaaatatggattgggacagacgtaggcctatatgtctattgcccacaaatggaaaaggtcaggcattttactctgataagtaattcaaacatagatatagactgtacggtcaatctgataactggggaccagaaaggaggtatctgggttgtaactcagacgcggggaatcttctattacaatccccaggatagccagttggttaattatcagtcggacgggtccggtactctgaaccttaaaacttccggccaactctattttgattcggacgatgtctgctggttggacatacgtgatggaaatctgtattattcaaaagacaagcttaaaactttaactccgatttttccagaagattcaaaagtgtctttcagagatgaatacatctataaattgctccccggaccctataattgcatgtatgtgggaactgtattcggactgaaagaagtgaacctaactaataagactatccgtacccttctttccaaggatgaattgggaggtgatatttatatcagggaacttgcattttattcagatgacgaattatggataggaaccgaatcgggactttatatctataatctgcacacggcaaaaatcatccacttgcagaacgtcaacggtgatccctattcaatctctgacaatgccatctattcgattctcaaagaccgtgaaggcggaatgtggatagggacttattttgggggtgtgaattattacccccggcaatatacctactttgataaagtctatccccagaaagaatcaaacaaaatgggaaaaagggtgcgggagttttgtgccgcccatgacggcacactctggataggtacagaagataaggggcttttccattattatcctagtactggaaaaatcgaaccgttcattcatccggatatttatcataatgttcacggattgtatttggacggagattatctgtgggttgggaattttgcaaaaggattgaagcgtattgatttgaggacatacgctgtaaagcactatgataatattgcaagtgatatcttttctatctgccggataactgcgggcgatctgtatcttggaacaacaataggattgtttcggtacaacccagatacggaacgttttaaacgcgtccccgaacttgggtggacgtttgtttattatataaaggaggataagcaggggaatttatggctggcaacttatgccgatggcgtctataaaaagaatgtccgtacaggtggttgggaacatttcgtacatgaggaagcagactcgtccacccttccatccaataaggtgctgagtatttttgaagacagtcaaaatcagctatggtttaccacacaaggaggtggcttctgccgctttgtgccttccgccaacacctttgtccgttatgacggtatcggtctgccaagcaacgtcatttatcggattgaagaagatgaaaagggattgttctgggtttcaaccaataaagggctggtgcattttaacccgaagaattccagttttaaagtgtatacagttgctaatgggttgctgagtaaccagtttaattaccagtccagctataaggataagaatggacggatttattttggctgtattaacggtttcatctcctttgccccctcctcctttattgataatgattttttaccctctgttttgattaccgattttatgctctttaataaaaaggtggtagtcggagaaaaaggctctccattgaaacaaagtatcactttgtcaaaccatatcgaacttcagtcaaatcagaattcgttctccttcaggatagctgcgataagttatcagtcaccgagcatgaatacactgctatatagactggaagggtatgattccgaatggcatacagcgggtaagggccctattacgtattccaatttaccttatgggacatacatgttacgcgtgaaaggtgcgaatagtgatggtgtatggaatccagatgtacgcacattggggatcaggatattgcccccgttttatttatccgtatgggcatacctgatttatatcctattgatactcggtacatttttcgccctcttcttttatttaaggaagcgtactattgaaaagcagcgtaaagagatggagaagttcgaacaggaaaaggagcaggaactctacaccactaagatagatttctttacaaatgtggcacacgaaatccgtactcctttaacactgataaagtgcccattggagaatgtacttgctgatagggaactctccgaaaatgtaaggatggaattggaaattatggatcagaacgtggagaggttactgaacctgataaaccaattacttgatttccgtaaagcggaaaataaaggttttaaattgaatccgaaagaatataatatcggtactatcgtccactctgtttataagtatttcaccactttggcaaagcaaaggggaattaaacttgaagtagaagttccagaggaagaattgttggcttctgttgacaaagaggctttgaccaaaattctcagtaatctgtttgctaatgcattgaaatatgcccggacatacgtttatctccatttgtctgttgatgagaagaatgaggtgttcactatctctatgagtaatgatgggaatatagtccctatcgaaatgcgtgaaaatatttttaaagcctttgtccaataccgggacgggaaagatattgtctcgggcacaggcatcggattagctatggctcgttacttggcagagttgcatcaaggtatgctggtgatggaccgggagctagattgtaaccgtttcattctttccattccaatattacaccagacacttccggatgattcggaagaacaacataagaaacctgggtatgatgatgaagatcgtgaagtttctgataaagataaaagagaggttgcttccatattggttgtagaagataataaggatatgcttgcttttgtgttcaggcaattgtcttcattgtatcatgtactgattgcggaaaatggggtcgaggcgttggacgttcttgaacagaaatctgtggatctgataataagtgacattatgatgcctctgatggacggggttgaattatgcaagcatctgaaacaaaatctggactatagtcatattcctgtaatattattgacagctaaaactaatctggaatcaagaatcgaaggacttgaagaaggggcggatgcgtatattgaaaagccgttttctatggagtatcttcgtgccaatgtagcaaatctgttgagtaatcgggaaagattacgccgtcactttattgaatttccttttatcaaagcagatgcaatggcgcagacaaaggccgatgagatgtttattagcaagttaaatgagtatgtattacgccatcttgataatacggacctgcaaattgatgatatagcggatgcaatgaatatgggacgttccaacttttaccggaaattgaaaggaatcctaaatatgagtccgaacgaatatctccgccttttccgtttgaagcaggcagcttccatactgaaagaaggaacctatggagtggtggaagtctcttacatggtagggttcagtaccccctcctatttttcaagctgttttaaaaaacagttcggagtactgcctaaagatttcatatcgcactagtaatatgtattttgctttaaattttataatatcaggtcattttctgatattttatccgagttgttccgggtaattttgcaaatatattaacaactaaatttgatgtatgacaaggtatttacttttttttgccagccagccttcgggcggaagagagagttgttttcctatcgtatatataaacgattcttagtttgagaatttgtactgtaatttatataaagtcaaagaaataattataaaataaattgcacacacaatgaataatagaaaagaaaatgaacagagttgtatagtaatgaataaaaaagagggtacatcgtgcattacgacacacctccctgtatttcagagaaaaatctacactactaatcaaaaaatctattgatatatgaactgtaaagtaaaacaaggatgccttaccagcgaaagctgttgcatcctgttatggttagccttcacattatttcccgtttccgttgtaacggcggcagataatagaaagatcgacgagagccagcaaaaagaagtaaaagcagaaatgaaaggatatgtgggagacgaaaacggagagcctgttattggagctaccgtattggaaagtggaacgcagaacggggttataacagatgtggacggtatattcactatacagttggcaaagaacgcatcattgaccatttcatatgttgggtaccagaagaaaacggtagtggtaaaagataagaagttcatttccgttaatttgactccggacaggagtatgatgctggatgaagtggtcgtggtcggttttggcaaacaaaagaaagaatccctcgtgggagctgtgcaggcagtgaagccggaagacctgaagatgacatccagtaatcttagtacttcatttgccgggaacgttccaggtatcatcgccgtacaaacacagggtgaaccaggctctgatgaggcgaaattctatatacgtggtatatcaacttttggttcgaatacctcaccgctgatcatacttgacggtgtggaaatcaacgctacgatgatgaacaatattcctccagaatctatcgcgtcgttttctgtgctgaaagatgctacggcaacgtccctatacggctcacggggggctaacggagttatcatcgttactaccaagcaaggacagctttccgagaaaatgtctgtagatatccgctttgataatactttctccatgcctacctatgtgcagaaaatggcagatggcccgacttacatggatatgtataatgaagccgtttataatcaggctattgccaataaccaagagtatgagcctttctatagccgggataagatagataaaacacgtgccaatgcaaatccctacctgttcccaaacaatgactggtacagtatgttgttcaaagacttcgccgttaatcagaatttgaatatctccatcaagggcggaagcaaaaatgtggattacttcctgaatgctggaatcttctatgaaaatggtatcatccggcaacccaaggaagataagcttgatgtgggtatgcgcaacaagaaatacctgtttcagagtaatgtgacagcccgtgttacctctacgacgaaagtggggctaaatatgaatacgcagttgttctaccaccatgcccccaaaacaagtacccggaatttgttcgcctattccatgcatgggaatcccgtacgttttcctgctacacttcctgctgaaccaggggatacatacatccgctacggtagcaatgatccgtgggatgtgggaaaatcagagccgaatccttacgccaaattgagtgaaggttatacggaacgaaattatgtctatatgacgaccgctttcaatctcgaacaggacttgaagtttgtcacaccagggttaaaactcaccggactggcatctttctataattacagttttaactggctggatcattggattgtacctttctactataaagtatctgatgactatacgatggatgatcagggaaactacctttataagacttcgactatcggtgagccgggagaaccttatctgaagagcaattccgggcgtgatccgacagagagtgtctggtctttacagggagcgctggactactcacgccagtttggtggacatgatgtgggagctacccttgtttaccacatgaaagaaaccaagaaagtgaaggacggcggagctgaaaaagatcttcttccttaccgtgagcaagggatggccggacgtctgacctacagttttggtcagcgttacctgcttgaggctacctttggttataatggctcggagaatttcagaagcgggcatcgtttcggattcttccctgcgattgccctaggatggactatttctaatgaaaagtttttccaaccgttaaaaaaaacagtttccactctgaaaatccgagctacttatggattgaccggaaatgatgcgcttgccactcgctttccctatgtaacagaagtcagtatgaataataatttggattggtggactggtagcggtacccgcgtgaatgggccgcttgtaaatatttatggtaatgcgaacgctacatgggagaaatcgaaaaagctgaatttaggtgtcgatatgacccttcttgaatctatggatataaccattgattatttcaaggaagaccgtagtggaatttttatgcaacgttcgtccgtcccttcaacaatgggagtgacaggtatgctgccttatgccaacattggctcggtaaagaataagggtgtggatatgagtgtagcatacagcaaagtaattggcaaagattgggtgctccgcctgaacggtagtctgacctatgcacataatgagattacggagatagacgaaccggtgaatgtagaaccctattcttcaagaatcggacacccgataaacagtattatgggatatgtgtctgacggattgtttacttctcaggaggaaatagacagatctcccaaacagtcgttcggaaattatacggtgggagatattaaatataaagatctgaatggtgataacgtggtgaatggttatgacaggacgattatcggcaatcctgaaattccggagattatctatggttttggaggaacgttgaagtataaaaagtgggatttgtctctgtttttccagggagtggccaaagtcagtttaatgatgagcgatattcatccgttcagcgaagcgggccataaaggatataacattgcacagtatatcgttgatgaccactggtcggaaagcaataatgtagccggtgccgcctatccccgattatcacccgaatttatcacgaacaatgcgcaaaccagcacttattacctacgtaacgcagctttcctgcgcctgaagaatgccgaactgggctattccttcttcccgtggctgcgtgtgtatgcagcaggtactaatttgctgacattctctccgttcagtacctgggatcctgaaatgggaagtgggaatggtttgaaatatccgctacagcgcacggccaagatcgggattcagtttcattattaattaagaacagaataagttatgaaaaatatatatacaaagttatgcctgtcggcaatcggctgtttaatgatggcatcatgtgattttcttgatgtggttccgcaaggtactgctaccgtggatgatatctaccggacacaatatcaggctgaaggaatggtactgtcttgctacgcgaatatccctaactatttccatccccaacaatttcctgattttaccggaggaaacgaaatcataacgagcaaaggaggaacaacgcgctggtttcatttccgcagtctggtttatggggaagaatccccaacaacgacttattactcattatggagcaatacagcaaaatcttatccgcagggtgctgtgaagaaagcagtatgggaaagtatccgcaattgctataatgtgcttaataatctggatagggtatcggacattacccccgaaaacctgagctggtggaaaggtgaagcgctgtttttgatcgggtattatcatcagatcatgctggagtactatggaccgatagttattattgacaaggaaataccaatggaaagttctccggccgagatgatgacctcccgttctccttatgatacatgtgtcgatttcattgccaataaatattcggaagcagctagattacttcctggcgtatgggattcaagtaagagaaacagggctacctcttctgctgccttggctttcaaggctcggctgttgctttatgccgcctcgccgttagtcaatgggaatagtgagttttattccgactttaaaaaccccgacggcacttttctgattaaccagacttatgaccgggaaaagtggaagagagcgatggatgctgccaaagaggccatagacctttgcgaagagaacggttacaaactttatggaaattcgaccaatgacttggagcaagggaagaaaaactatcatgaagcctttgtcggtgatgggatcagtggtagcggatttaactggaatgaagtcctgtttggctttgctgaacagggaactatttcctactgtatcaagaatatggctcctcgtgttgaatttacaagttattcgaccaaaggttttagagggtccttattcccgacgtgggattgtgtgagtaggtattataccaagaacggtctaccttgggcagatgaccccgagactaagaagcttgatccgtattccattgcaccaggtgatagtacggtacgttttcacaggaatcgtgatccgcgcttttatgcctctattggctttgatcgtggaaattatgacgtgcagggaaagacaatagtgctcaaatgcagacgtggtgaaatgcagcagaataatggcaatgccaaggatgagtatcaaacggacaacggttattattgtcagaaatgggtgtctaaatatgatacctataataggactaccgatcaaataacctacaaccgttggtgctttccttatatgcgtctggccgaactctatctgagttatgcagaagcggatttcgaatatagcggcacactgagtactgccagtctgtcctatttgaataaagtacgtgaacgttgcggattacctacctttgcagattcatgggcaaaagccggtggtattccttcaggagagaagttgcgcgaaatattacatgatgaacgctccattgaattggctatggaaggcagacgtttccatgatatgcgccgttggaaaattgcccatactgaaatgatgcgttatcagaaatcctggacattatccggaaaaaccgctgatagtttttataaacttacggacatgaaagaaaccggcgttcgtaattttaccgctcccaagaactattggcttgctattccacaagatcagatagaagtaaatcccaatctagtgcagaatccgggatactagagaatcagctcttatataactaacaattagaggaaaggacaaaatgaaaaaggtaatgtgtttattggcaattatgtttatgattgccaatacttcggcacaaacacgggtgattgcccatcgtggtttctggaaaacccaaggatcagcacagaatagcattacatctttgttgaaagcggattctataggatgttatggttcggagtttgatgtctggctgacaaaagataatggtttggtggttagccatgatgggattattcaagggcataaggttgaagagtccactctgaaggaattaaccgggttatggttagcgaatggagaatgcgtaccctccttaaaagagcttctggaaacagctaagcggaaaacatctttgaagctggtgctggagttgaaagctcatagtaaacccgaacgggagataaaagctgttgaagagatcgtttcgatgataaagaagatgggactcgaaccccggatgatatatatcaccttttcgtctcacgcattaaaggaactgatccgtcaggctcccacaagcactcctgtatattatctgaaaggggacttatctccacaacaactgaaagaattgggtagtgccggaccggattatcacttctctgaattttaccgttataccgattggattgaaagttgccatgccttggggctaaaagtgaatgtatggacggttaataaaaaagaggacatgcaatacttttgggataaagtcgactttatcactacagatgagccgttgggactgttgaaagatataatgaaggtcaaatagatatattttctgagataatgtatagtccaactgattacctttaataatctgttgattatttatgtttttggaaaatgagtttcaagttttcaaacgactgttcatgttgatacagttgaatgctgattgaaaacaaaacaatagcggaaacaatgaatgtcaatcttgtataagaaggcaaacgtccaaatttatagttcagctccattaatcgaactgaataggggtatttattaaataatataaaattagccaactaattcatagccaaattattgcgaattagttggcctttttgtatctttaggtattccgtgcgacaagaagtcgtacaagtaattgttcagcactgtgcctgaacctattgttctgtcaatagtagtctaaagaggcgtgctttaccagtcatggtttagtgcgaagccctcttgacaatgcagtcctttacagaaatatccaatgtataggctgttaggctgactgatatgagtaacatatgtgaatcgctacaccatcgtaataaagaaatagcttacggatatttataagctatagccaaaaggtgggtagtcaggatagtcttttgggaatgtaaggctacacggacatcatactggcggtggaggggcgggctctaagtcgggcgtcagttacttgtacggaacttggtaaacccgtatttctcctgtctatgtcaggcaggtaagccaattgcaagaaaagccgaatgtggtgcgggtaaaggattgcggagaaagtgaatgattctgtgtaatgcggaggatagaggtttaaacatcaccccatgcgaaatcaggcagacttccgcagggtaattctttgtgaaacgattgtagaactttaataaaatgaagaaactgcaaatgagcaaggcaaaagccgagtgtgcatctttaaccgtacgaaacacgacatgaaaagatatcgattcttccaaatatgagcgtaaagtgagaaaactgcaggtccgaatagcaaaggcccacaaagaaaagaggtacaacaaggtaaaggccttacggtacctacttgccacttcctacgaagccaaggcattggcgataaggaaagtaacttccaataaaggtaaacgtacggcaggggttgaccatatgaagtgggacactgatgccaagaaaatagaagctatatgtttattgaaaaggagaggatataaggccttcccgctgaggaaggtcaacatagccaaagcaaatggcaagacaagatctttgggaataccaaccatgaaggacagagccgtgcaggatatatcttatggctttagaacttataactgaaagtgaagcggatgcgaactcatatgggttcagaaagtttagaagtactgcggatgcaatagacgcacttcatagatggttgagtagagactgtttaccacaatggatactggaaggtgacattaagggttgttttgatcatattaatcatgaatggcttctcaacaatgtgtagattgacaggctggtattaaggagatggctgaaaagcggagtagtatttaattgcaaagtatcaatagatacgctacactttttcttttcgttggcaaatcttaatccgtatcttcgttgcatgaaagaagatatacggatgcgccaaaaatggcttgagctatacgtcgaaacgggttctgtgacaaaaactgcccttcggtgcgggattacccgttccacgttataccgttggataaattgcgagaaagaacaaggcaagtcggaattgtccgataagtctaaacgttcatcaagacttgccaatatgaagataacacctgaaattgaaaccattatccttaatctgtgcgtgagacaagaagatggggagcgcaacggattgccaactatctgcttaggaagagaataaagctctcaggcatgacggtgtggcgtgtgttgaaaagcatcaggtcaaagctgttgtgaaacgttgcgagaaatttatttcttcttccagccgattttttccatcggcaacatccggataaccatatacccccgccgttgttcatagcggcaggaaaaacatgcctgacggcgatacgtgacgcacggcactcaaaccctctattccaacgtgaaactgaccgcagagagggatgccgccacgggcgacctcgtgtggaagtccaaggacaacacgacacttgtggggggattgtcggatgagcactactacctctactatccctactaaacggatatgagcggaaagactgccactcccacaggctcagccttgaccgacacggaattcttcgccccgttggtttccgcttggcagcctcaggacgaccaaagtactcatgcggcatataccgcctccgacttgatgactgccgaaggctccgcaacgacaggggaagacaacaccctccacctctctttcaccatgaaccatcgtatggcattggccgtcatcgagatgccgaataccgttaaatacaagtttaccgacgagaggattcctgattacgccgtgtcacccgccactacattctctggcattgcccagccgctgcgcgtgaacgatggtacataccgctacttggtgaatcacgcgactcccgcaccgactatcgaaggacattatgacgagggaagcaaggagttcaccataaccccgtccggcctttctaccggcagttacaagagatacaaggtggacggcgcggtgacaactgtaaaggactacacgatgcaacggggagattacctgctcgccgacggcaacctgctgcctaagggtactaccctgaccgaggagcagaaggcaagcgtggcggccatcgtcttctggacaccggcagagaccaatcctgaaggacggatcacgccggcgtctctggatttcgacaagattatggtgaaagaacatcccaattgcacccatggccttgccgtgtcgattaaagatgctccgggcaacgtctcgtggcaaaacgttaacgactgggtggcggattttcaaagaggaacagatttcaatcctgtcgataaggatgagtacgtaaacattgccactggtttcgatgcgaccggcaacataaacaggatactcggttaccagaacacgaaagtgctgtgggcgtataacggatattgcaagacaaacggcaaaaccgatgccttggtcaatcctgctgaggtcctgaaaacatttatcgcaaataatccagccccggcaaacagcaccggatggttcttgccgtcggtaaaggaactgcacatgctatgttataaggatgtcgataatattgcgtacacacgggacaacacagagacgagggatatagtcgaagtctccatctccgccgttggcggtgacgcattgtcaccgcgcaataaccataaacgtttctggtcttcttcggagagccccagtaataagaatggcgcttttagcgtgtatttctacaatgccttcgcacagctcagcgaaaaggacggcgcactcaatgtgcgtgccgtgtgcgctttctaaccacataaaacaaagaaaaataacgatgtgaaaggaacaggatattccggacgatggatgcgcatcagcggctggtagccgatgttgatgctcgcgggcgggctactcgtctcttgcggcaagatggaaacgggagaatctactacacgtttacccgatggcaagtacccattgcgactgacagcggaggtggcgcaaccgcacccccgtgccggcggcaaggagataggagtgatgctggatggcatgctcagcctccaaaggtacgtaatggacgcctcgggcaatactgtcccaaaggatgctgaaaacaccatttaccggaagagcactaccgagacatgtgtcacggcacggactccgaatgccgatatcgaccaaagtggcgggtatgccggcttcggccttctatacgtcaccgtagtgggaggttatgaccaagccgtcagcctccgtttcaaccaccgcatggcaaaagtagagttcacgctcatggcgggcgaaggtgtcacggaggaaaaacgaatgaaatagacgtggtgcagacggtgccgggcaacacctggattgatggcggcgaggagaatgtggcggtagccaaaacaatacactacactgccgatgaagtgaaggctggggactacatctattcgggcaggagcacttcggacggcggactgcgcaaacgctatcccaatgggaaagctcaggtcatcgcagacccgaagccgcaatccgtagcgggcaagacggtcgccggtgtcgtcttctgtataccgaaagacactgaccccacaggcagactaaccccagcccgacttactgatgataagattatgatgaaagattttccgaatgccgaaatttggaattatatagtcaacccatccctcgtcgctgccggcggtccgacgccaatttataccacctcttactggtcgtctacggaggcatattatagccctaacaatgcatatgccatacactttccagatgccactctggaaagtaatgataagtacttataaagttaggtttctggccgtgtgcgctttttaatcacattaaagaaagaaactgtagcaaagcattctacattcgattccggcggcggtgctcctatcgcttgccgcctgtacgcaagaagagctcccgggcaaccaagacaaggcgcagcaacttactttctccgttaccgatggtggatatacgtcggctgttcgcaaaaccacccgtactgtggagaatggctgccaaaccaagttttccgaaggcggggcctgcggcctatacgtggtgcggggcactcaaacagtctattccaacgtgaaactgacagccgagagggatgccgacacgggcggtctcgtatggaaaactgaaagtccgacaccgctcacaggcgggctgttggacgaacactattatttctactatccctatcaggcacgagcctcaatactggggcagggcggctgttcgccttcatcattacggtgaacgagttaaccgtgcccggcttgtcggtgcggagcgaaacatacaccatctccgacaataagacctgccatatcctggagtctgtctgcccgtgatgttatcctctcatcgaattcctgtactcactcgggctcattccatagtacttcctgaacacctccctgaaatatctgacatcggagaaccccgagtcatccgagatttccgttatcgaacagtctttttccctgagcagttgtgccgcatattgcagccgcatggagcggatatagtcagccggggcatggccggtgagcgccttcaacttgttgaaaaatccggtgcggctcatgttctgcatgccacagagcatgtccacacagaaaccggggttgtcgatattcttcatgacgcattcccttacggaggccatgaatttccagtcccgggtattgtggcagtccggcggaacctgtccgactccgtcctcaagaccggcgtatgcccgtttgagcagtgcccggtttgccagtatgttcctgatattcgccctgagcacgtttatgctaaacggtttggtgatataggcgtcagctccgttttccagcccctccagcatgtccttctcatctcccaaggcggtcagcagcatgaccgggatatgggatgtctcaatatcggatttgacggacgcgcaaagttcgtcccctcccatttcaggcatcataacgtccgaaagtatcaggtccggattgtattctctcgccacaagcagcgcgtcccgtccgttggaacaggtttggaccaggtattcctctttcagcagcccctcaaggtaggtccgcaaatcgtcattgtcctccacaataagaatacgctgccggtccccgccggtcattgttggaaggatctcacgcatggggccgcaatccggtcccatgcgggtttccccggtatcctgtttcctgggcgaagcaacggggcatgccttgtcaaggcgtctgctcctcaggggaaaaataacacataccatggtccccttcccctcggtactggtaacgcggaccctgcctccgtgcagccttaccagcctatgtaccatcatcagtccgacaccgtttcccgccacttgcagattgacggcattactgcccctgaaatggttcctgaacagtttcttccgttcctcaggtggaatgccaatccccgtgtcttccacttccacaccccatacatgccggtccgcgaaggcacggacctggatactcccgccccgtggagtgtacttcagtgcgttggacagtatattcttcaatatagagtccattttgtccttgtcaaaccggacattcaggtaagggaagccgctctcacgggtgatatcgatgtccctgatggaggcatatgtgcggaatgcctcacaggtcgtctccagataactgttgagctcatattccgagacatgaagtctcaaggtgtagttgtccgtactctcgaaatctatcaggctggtgaccaatcccagaagtccgtccacgcttttcagggccatccgtacattgtccatcccctccgccttcaccatgtctttctccaccacctcttccagcggagccttgatcagcgtaagcggagtacggacatcatgggcagtatgtatgaagaagcacgtcttttcgtctgatatccttttctgcctgcgcaacatggcaacgcgaaaagacaccaccccagccaacacacacaatgacgcatatccggcaatggcccatgtacccgcccacagcggccgggcgacactcagaccgaggcttctttcctcatacaccttgtatttctcctcattggagacggcacggatacgcagggtgtagttgcctgggggcaggctcgtgaactgtatccgcccgctctggaccggatggctccagccctcgtagagcccctccaatttccatgaatataggatgttcgagggatagtcgtagttgatggagacagcttccagggagaaggtattctggtcatatgcaagttccagcctgacggtattgtcaatatcctccctcaagggggatcccttgtccccgggatagacggggcggtaggagatcatgaaatcccgcaggagcatccgagaaaaatgcggggcgggtatcctcatgtcggaggggaacatgacggctccggtgttactcccgaacacgaagctttccccgtgccggaaagtggataccccggcattgaggcatacgcttgccagcccttgttctgccgtccagtttctgaaagtgccgctctcacgccggaacagggccacgctgttttcggtccccagtagcagggtgccgtccgcacgggggacaatggtatggatgttattggatatcagggcgcagttctcggtctggtattggcggacgaacctgtcctccacgctgtcatagacgagaagtcccgccccgccggtgccgatatacaggagcccgtccggtgcctggtacagtgcatagacatgaaccgcctcgactggaaaggcgatatgtctgcaggtccccccgtgcccgtcaagcaggtacaaccccatgccggtaccgatccacatccattccggagccttctccagtatggcggtgatggggcccgggaccgggtacaggcgtactgtgccgtcatggggatcgaaacgtttgagattgtggcagccccctgtccatatacatcctccggaatcttttccgatgtcattgatatactggtctggacgcccctctgctgcaaaggaggggggaaagtattccaccctcccggttttcttttcgatcctgtacaggcccgaagcgtacccgccggcgcagatgacacccggcgagacctcgcagagcgtcaggaagatatggttcccgccatcctgtatcccatcggaccggctgagaaaggagcgccaccgtcctaccgcaggctgcagcaggctgatcccgttgctggtggcgaaccacaagtcgccttcgctgtcttcgatgacatcatgcacctgatcgttaaccagcgaccggctgttgcccggtgagtgccggaaccattcatagctctggtagcggttattccggattgtgactccggcggggtagttggcaagccagatacggtccccgccatccacataaatgtcattgatattgtctccgttcatgccgttgtggctggcgtagtcggcggttatatagggtttgggcactagcgagtccatatccatcctgtataccccccttccgcccgtggctatcagcagctcccggtcattgagaggggtgatccggttgacggccacattccgcagcgtactgcctgcggacactccgtatacaagtatgcccttcctgaaggttcccacgaacagtttcttcgaaccggggtggtagtagagttcgctgaccggcgtccggatgctgtccgtgtccgcaagcgcctcaaggacaccgtccctttcccgtaccggaaaaagtccgttcacggtaccgatgaaaaggtttgtaccgtccgtctcgctgatagcggttatatcacctcttaaacgggagaccagccgctgcgcaatgcctgtgcgggtgtcatagcggatgatatggtcaccctgacagagccatatgcggtccccacggtccatataggcgtaacagagcatgcccgtggcgaagtcatcctgaagaccgggtatcctgtataccatccggaaacggtcatggagggtgtcgtaatggaaaatacggcctttccttcccacaacccacagcgtgttctccgtgtcggtgtagagccagttcagattgacttgcggggccaccttcagattgccgtcaagaacagtgtaatgcctgatccgcttgccgtcataacggtccatcccctcctgggtgaggaaccacatgtatcccctcccgtctttttggatacggtaaatcctccggttactcaatccgtcctctattcccaagtatttatatatctgggctccgcacatggaggaaattcccagcatgaggaatgcggacagtattcttcccatattccgaacacgtgtcattctgatgtaaattagacaacaactgttgcaaatatataaaaatataaattaatatacaaatttaaacataacctcggatgtcggcatcaggcggtatgtcctcaatgtcatgtaccccggaaaatagctgcatacgggaccggcccatgatatgaacatattccgagaggcggttgttcaattgacccgacggaattatggcttgccgggctcgggactgtccgcaagggtacgttggtccggtgtgcggaataccatccatacctccggtccgaatttatatccgcgggtggtacaggtgccggtcgaggtttggcagcccccaataaagcgggccgaattgtttgtaagcactcttaccctcatgcccgatttatagataatcttccaacagtaagaagttataattcgcatttaagaacaatggcgggcatttcttgttaatattataatcatataaaagaggcgcatccgttagtgccagatttgttcaccactttcatcgttgcgtatcgtattgcgagttgtccgtatcagatgtttatcccctctttcttaagacttcctgagaactgcctgggaaaggacggctttccgcattgcgacttcatccacagcccttggcggtatagccatgcctttcacggggactacggttgattcatgcgacacagcagattccggtgctataacagggttgcctacatacttgtgcctcttttcagcttgctgtccagatccgagttgcgcactttacccgcaggttggacggttgtacataacaatattgatctttttgggggctaaaagtcgaatatccccttaaagtaagcgcctgagtaagtacatcttctacagttcattttccctccttacttttgctgcaaaaaaaataatatcctatgatgcagcgacgtaaacacatgatgagcagagaaaaatttatctccgttcttttccgtcagcagcagagtggtttgtccattgctgatttttgtgagaatgaaggttatagccgtagtagattctatctttggaaacaaaaatacggtataacggagcgggagttattggcagaagcctcccgcttaggggttaaagacagctttgtccccatagtaatcaatggcgacacgccatcccccggtatatctcacgaggctcccctgccatctccccagcctagcgtcccctttcccttgaaaggaaaggacagctctgaaatatccttggaattacccaacggattgaagttgaagtttaaagggtcttccggctgtgaagctgccctgaatctgatctctaaaatatataatgccaatgttctgcctaaatgacagcatgagatatttcctgtgccccggttatacggacatgaggaaaggtatgttcactctttgcggccttgtgcatgagaggatgggaggcgacatcagaagtggggaggtattcattttctacaaccgtttccggaccaagataaaattgctccatgccgaaccgggcggtctggtcctttatgagaaactgcttgaagaaggcaccttcaagatacccgcctataatcctgccacccgttcttaccccatgacctggagtgacctggtcgttatggtggaaggcatcaatgaagatgtcagcaaaggcaggcaaagacggctttccaatttgaaaaagcattggtaaaacagttgtaaacaaacagcttgaaggcttgtttttcttgttgtttttgactatctttatatcatcaaaaaaaagatattgaatggcaaaagaagatgcaaccggacaagctgtggaaccctcaatggagcagctgctggatatcaaccgtaaacagagtgagatcatctcagcccaggcaaggaccatagaagaactccggggtacgatagttgagttgaacgcctccctggcatggctgaagaggaaggtgttcggaaagatgagtgagaaatgcaagcctgtcgataacggagacccgaagctcccttttgactatggcgacctggaacagatagaggcggaaatcgaagatgcccggagcagggcggctgaacagattaccgtccccaagtcccgggccgccaataaaacgccgcgccgtaaccgggtcgtcatggataaccttccggttgtaacagtcgtcatcgaaccggagaatgtcgatttaagcagatacgtcaagataggcgaggaacataccaggacccttgagatgaaacccggctacctctatgtgaaagacacggtacgtcccacatacgccctgaaaaatgaaatggaggccgttgataacggagaaaaggctgtaataaccgctcccatgccactgatgcccatatataaaggtatgccaggggcttccatgctcgctgaggtccttttacagaaatacgaatatcatgtcccgttctaccgacaagtgaaacagctggaacatctgggtgtgaaactgtccaaaaacacattggacggctggttcagaccggtctgcgagcttctcaggccactttatctggaactcaggaagaaagtactggccgcagattacttccaggttgacgagaccacgcttccggttataaaccacgacaggcataaagccgtaaaagaatacatctggatagtccgagcggctgtgccgcgtctgccttcttccattacgacaacggatcgcgttcacaaaaagttgcggtcaggcttttgaaaaacttcaaaggatatctccaaagtgacggccatcccatttatgacgcctttgaggatggggaggacgtatgtctgtgtgggtgtctcgcgcatatccgcagacatatagagctgtgcaaggaagaaaatctggaatatgccatgcagggactcaaatttatccaggatatgtataatgtggaataacatggcggataaacaggaactcccgtatgaaggacgtgctgaattacgccaacgtctatccaagccgatgcttgacagctttgaactctggcttaaaaacacataccctaaagttctaaaacgaagtcttatgggaaaagccatagcctatgcctactccctgctgccaagaatgaaaccgtatctccatgacggaagaattttcattgacaacaatcgctgtgagaatgccctgaggccactggtcatatcaagaaagaacatgctgttctgcggaaaccacgaagcggctgagaatacggctataatctgttccttgcttggctcatgtaaggaacgtggtgtcaaccccagagagtggctgaatgatgtgatcagtaaactcccctattatctggctcccaaatcagacagagacctgaaggaactgctaccggatgtatggagaaaataatcaggacagttccgggaaaatgcaggaaaaaacgggaaaaagcgagactgacactcaatgacaaccctgagataagttggtatatggaaattgagatgcacttacaatggagtgcatcccactgaaaaattgaatgcacaagatgtagttgagcagtcgcttaccccttaaaaacaaggagctgacgcatgtgtacagccccttattttttgtatagcccggcctcctctggcatattgccgttgcttccatctgtaacaagcaaaatcagaatctatatgcggaactttttgttcccgtagctgagaaagtccttcgtggcatatttcacactgaatggtccgtagtcaccgagagccgaatgcgcaatttgcttgtccggttctgtcacatgctcgacaggttctcccgtagtatcagtatccttgtatgacataggctgcatgctggcgatggctgacccggtagccgccgcacgcaatttcctgaacgcattggagaggattccgtccatcattgaccagtacaaggcgaagaacgaggtgcaggaaaaggaggtctcacagttgtaggagatagccgggaaggtatggaagaaggaggacgaactgaaacagttgaagtccgaacttgcagcactcgaccgaaagatacagttggagcttgagccgcctacgcccgaagtcgccgaaaaggagaatgacggacaggaggtcaaaccggatgcggaaggtgtacgaaacgtatctccacaacacaccgaagatgtgccgcagatacgcagctcggtgaatgaacgcagtccgtctggcaattttattgccgaccacatcatcatcgggcggccgggattcaacgtccgtgacgagtgcaaaccgaaaggtataaaaatgtgaacgagtgtgcggatatatatggcaggattgggaacataccattccttttcctgctttttccatcaatatgacataatggcaaggataccatacaacaagccctcgattatatcaaaatagggtgttgaaagtaaatcgtcatggcaaatccgccatatattcagtattttcgctaattttgcattcaaaatagttaggcataataaaatggaaccatctatatacagttattcactttgtattgcgctaccgttgatgttgttcttcggcttttattttttgttggctccaacctcggaaaaagccattttcaataattatctgcgttcccggcgaattatgggggtagccatactgttacttgccgccaactattcggtacatttcttttttggaatcaggttcaagaataccgatgccgccatcctgatgaacctgtccacctattttttgtgctactggttgttcagttcggccctcaccactctgcttgaccgcttttatatcaccaaacgtcggttacggacgcatatctgtctatggatactgttttccatcctttccggcatcgttctgctgttgttaccaaaaggtggtttacagacaacggtgatgtttgccttggccgcatggttggttatctatgggctgttcttgacccgtaggcttctccgggcctatcacagggtcatccgcattttcgatgacacccgtgcggacgacatcggtgcctatatcaaatggctttccattttcacctactgggctgtcacattcggggtgggatgcggactgctgacattcctgcctgatgaatacgtctatatctggattctgtcatcggtaccgttttacatttatctcttcctttgctatctgaactatctgctgttttacgaacaggtggaaaacgcgatggaagatggcatgacttctgaagaggaagacctgtgtgacaccacaaaccgggaacaggcacagaggcaggatactccttttttccatgccgaaatagcgaaaaaaatcaaaggttgtatcgatgcggacggttatatccggcccggccttaccataaaggagctttcagatgtgcttcataccaaccgtacctacctgtccgggtacatcaaaactacgtatgacatgtcgttccgcgattggattatcggacttcgtatagaatatgcgaaacgtctgcttgcgcgatatccgaggttgacggttgccgacatctccgagaaatccggttttttgtcaccaagccattttataaggctgttcaaggaaaatgcgggctgtacccctaaatggaggaaaacagaggcggaataatacggtgtgttatggatggaggaatagcccaaacgacaaaaaatagcctaaactacaaaactaaaatgttctaaaccacaaagatgtgcgattctgacaattgagacaatttttataggcaagaatcgggctgaatttaaatcttttcgcttattttgcacttgtcggttgagcctgcgtcatctccaaaaagagtaaaacagggttttatgggtgattttaacgtgtgtaaaagaaaatgctacccaaataacttcaaataaagacaactctatttcaagcggcaaatgagttctacagcttgaatttgaataatacaaacaataggattctcctttaaaaagtcatgaaaaagattcatttacttcattacttattgttgtgctacatggttcttgcggtagctacatcgtgcggcgatgacgaggatgactacgcccccgacaatgtaaatgatcccgagaaactaactgatcctttgcctactaccgaccagttaggcgtaacacacaacaacacgctttattacctttcgttctggagcaaagaagaccatatgatatccgagaacatgataaaccgttacaaggaggcggttccttatgctccgggaaagaagatggaggttggcgacgcgttcttctttacccggcaggacattgaccggattcagtcggataccgatttgctggctgacatcaaggatatgttccataagcggagcatcgtgatgatgatggagggaggaacgaacgaggattttaataccgtctgcacgttgctggattgctataatccttatgcgaaggaagatgagtcttattcggacgaactgccgctgtgggtattttctggaccgcttccgtcggcgagcggattctattccaagctcaatgcgctcagtactgctaccggagctgatggcaaagaatctgtacagacgattaatgaatacgggcagggatttcattgcgacatgacaagtcaaagtttacaaagagccctggaaccgaaagctccgtcaaacggttcgtcggatttgaaaaacttgatatctgcctatatcgttatcggtcaaaatagctataccgcacctcctgttcatggacatgaaggtaaagggacaaccgataattttcaagtagaagctaagatatggaccgcttatagcaaagaccggaaagaacatttttatttggtaaatctgggttttatagcctatgtagaaccttctttttatggagaatggcataccaaggtcagtactctgaaaatgaaagggtatggcttttgcctgactgacgtaaatttggaattcgctccggttcacccgaatggtgccattattcatgcacattccccgcaaactacggaacgccagagctcttataccagcagtgtctctttcgagttaggaggaagtgtcagtgtcactggaccagagatttcaggaggaataagcatttccaatagccatacggaaacaataaatgatattgaagttatcaatagaaccaatccggcccaaggaagcccacagcttaggtggtagtttaatttacgcgaaccttcttcacattttaatatgttttgttacgcgtcgagtgctgtcaatggaggtgctaaggccgggataaccacttgtagcttgtccacagattttattatttctgtacctgatggagctgacaacgaatggaaagtaagcatgtatccaacactgaaaacatatttctttagtgacctttttggattccatgatcaatatgaaacgctatttgatgatgcggcagaaagctggattggcatcgaaaaagtttttaacttgccgactgtcgatctgaaagatgaatgatttgttacgttgatattaataatttctaaagttattggattatgagaaaaacattcttggtgatgagcaggcttatcgatttatttgtggatatcttgcctatagatgagcttgggtttaaacatgtcaaacttcaatcagaagggagaccaccgtataatcctgcaacattactaaaattgtatttatatggttataagcactcaataagatcatcaagaaagttggaacacttcctgtaaagtaaatgtggaattatggtggctattaggaggcttaatgccctcttttcggacaattgcttatttaaaaaaaaataatgcggaggcttttagaaaagtctttaggcagtttgtccttatgctaaaggatatgggtctgatagaaggcgaaaccataggtatagattctttcaagatatttgcccaaaatagtctcagaaacaattatacacaaaagaagatagacagacatcttgaatatatagataaccgtattgaagaatttgaagtagctttagataagactgataaagaagaagaaaaagaacttcttaaatctaagattaaattacaacaagacaggcgtaagaaatacgaaactcttgatacggaattgaagaatagtaatgatactcaaataagtctaacagacaaagattcaagagcattaatgttaaccaataatgtatcaggggttgaatatgcggttcaagcagcctttgatagtaaacacaaattattggttcactctcatattggagcatcaactgataaaagagaactatcaacagcggcattgaccgtccaggaactactacaattagattcgttcaacacacttagcgatgccggttatactagcggcgaccaactacaagcctgtaaatattcaggaatatgtacttattcatcgcctatgccatcaacatcacctaattcgaattccataccactggctgaatttcattatataaatgacggagattattatatctgcccttgtggagaacaaatgacaacaacagggaaatggagaatccgtcccaattatagatcaaaagtatataaaacatcagcttgtgtaaattgctcaataagagaaaaatgtactcaaaatcaaaatggcagagtaatagaaagaagtgaatatcaagatgtaatagatgaaaataacgccagagttatgaatcatctgttgcaagggcgcgcagcagacattcgtaatgtcgcacaacttccgcctcttcaccgccctgacgggaactgccacagccccccaaaaacagtccaaacaaaaagactaaaacagttgatcgtttcatggtgctgtttgtttaatggttaaattactggtcatgcacacaacggacactaccgcccagcagataatgataaccataatattcattaaaccctgcaggtaacccggccggactatgaatgtcattaccggcaccatgcattaaggcccatctattacgattaaccctatatgtgggcgctgtttttccagctccgatatcaggattccaatatattcctgtatgtaatacagaggcaggagaatgtcgttgaggtgatgaatatatcattggagtttgtgtccagatagctaaaacgccttcttcatatccaccatcgggggcagatatggctggaaaagacttagctattcccgcaccgctttctatcaatcgagtaaatacaacaggataagagcctgttatagactgtatcagattaataacctcccaagccgtagggagtcgccagccatcggggcaggcacgttggggaatactgccataataaatgggtccgaccatagctggtgccaaagaatatgaacgaggacgagcagccatattaggacctccttccctactggcgtctatcatccaacaaacaccaccattacccatacgggtagtctgatagttactgccaccgatacgcataagtttcatggaatttccgaaaccacaagccggttgctggcttacatgcaaacgatattccaattcgttagcagaatttcctgttcgtatggaaaggacagcactacgcatattctgggtaaagttcttactgtttgccgaaatagtaaccgtggctggtactcccgctgtacccgaggtttggctgagtgaaatccatgaaggttttccggttatttgccaattggtattctctgtagttatatttacgggtaatgaagcgacacctatttggatatcaccgtcaaaagcgaacacccgtttgtccaccgtcagccgtttgttccctcgtactattacttcttcttgtacctcgttccacggcacgatacggcatttaagggtatggtttcctttgaaagcttcctcgggagtttgggccggcaacccgtccacactttccacttgtactttatattcatgattacgcagaatatccatcggcactcccgaaccgtagtccttgaagtcgaggcggtagtaaccgtctaccgacggcttagagccggtgagatacggcttcacgtgcataaccagacaaaggtcgtccagcgcattcccgcccgaggggcggttcttgttgtccacctcgcacaggtagaacgtcttttgtgagccgttgaaaataccgatattcccgggtgacacatcgctgttcaatgaggtgaatgtaccccgtgtctgccgtgccccgacgggtacggtgggagtattcacttgcttgcccgtcacattatagttgtccggtgcaatgcgtccttttgcccggtaattgtacagccgcagatcgttgtaataatagaaaaagccttttaggtcggattcaagaggattgataagcgtgaacttagctaccgcacgtatcatcgtcacctcttggggagcgccagagggagagaaaccttcgcccaccgcttggttgggaagctcgccccacatgggtatgccattcgtaaagtcgggtgcggcatccgttccgacatcgaatgccaggcggttcattaccccctctttctgttctccgaatgcagcagcaagggtattcacctgctcacggacattggcaagcaccacgagtgtctgatgttcgggagctcccatcagctgtacacgtacggtttgtgtgccgatatcgtatgtaccctgtgcacggtagaagaatgtacctttctttatattcgtaggatctgcaggatcaaccttgaatgaaagtacatctacagtattgattccattttcatctatagcacgtgtcagcggcgcacgcgtttcggaactttgcgaggtgttcatttcagcagcctgttttgaagcaccggttttaaagttcaggtaaataacggctgtatgtccgttcgcttgcggcaccgactgctccgcatcatcactgcaagcggtcggaaggagcgccgccattgcaatccacagcacagctgaggcatgtcgcctccacagatatgccacacgggtgaaaccggataaaccggaagtctgaaatcctatattcatttttcttctttttttagtaatatatctattttttatatcaactttcttacaaactaaattgcatcggtcatataccgtcttacttatttatcggcgaacagacgaacggaaaacccgtggtgtttaacgtctctgtagttcgcgaacgcagagtacgagtagaaagacacgttccaagcattgccgaggaggctgggaaactccgtgctcgaccaataccgaccatattcgcctcgggcttcgagcaaaccactcgaaatgaacgttgggaaggagatataaccggcagccggaaaaatacgaacgacagcctcggaagtatggctatcccaccaagaatcattattgatagtgctaatgtttcctgtaaatgcgctgcccaagtaaacacaatccactttcaatagggaagtaaagtcatggttggcaaacgaacccacgcgggtgtaacggtaagcacaaaccatattattatcagtagcaagagggaaatcggatagggaagaatcatcgataggattaccggtaccttgtttgaaacgcagagcgtaacaaacaccgttacccgaagagaaataatcgttggcgaaagtttttttgatgccaccgaactcaatagcctcgttgacattagaagtattagtaggggaatcatattgggtattaccgctgtaggagaaaacgcccgtcaactcccagcgggaaggcaggtggtaaccataaccgggatgccccagtttaaaaaagacatcatcaaagagtttcttggcatttggattgtaagtatcattattctctcctgtgagcacgtaccaattataataaccggattggtcattgctatggctcgaagcccaatgaagattagggtcagtctgggctgcagtgggagaaatacccggaggaacggaagaaatgaaaggagaattatagatagagccaccggcgaggttatattcggcaacataatccaaaggcgtaccgatctgcttaatattgattttagtataaagtcgtccagcccgtatctacagataaccatccttgaatcccttgccattcgtgatggcctgcaattcctccgtaaccggattggtgagagtggcgccagccgccccactgttttgactgggtttcagccatgaattagaaactgaaattgttgttccgtcggcattataggcaccgaccttccacccactggggtaattggtgcgcacagaaaatttgttctgtgtgcttgtggcatcgtgcttgccttgaagtgtcatcgccgttcgggtcactgccaagaaatgccccgattcattgaacgttatatctgtgaatgcgtctatcacgatgggcactactacgatgttatggttggtaaagttgtccgggctggttacagcctcgttcaaagtggcaaaccccggccctttcacttccttgatggtgaaaatatagcggtggttgcgcagaatgggcatgtatttacccttttcgtaaggactcgtgccaccgcccttgataccgtcccatgtataatccattcagtagtagtattctcttccttgataggcaagatttataactatacaaggacggctgccgccggagatagccgactgttcattcaaataataagtgatgacattcggagatgcggtgtttgcagttccctcaagcgggtgcccgccactgactgctggctgcgatgtggcaggcagtgtgggagtcatgtatcccgactgtgaagcggtggtattgtatgtagcaagatctacccaaacgcgtccgttgcctacggaattgacgaagtaaacctttcccgcagctgtcgtggctcccgaagttgtaggattgatgatatccaccttcgccagcatgcggataagcggtatttcctgcgcaatggtttgcgacacaccggctttcagttcaaagcctcccgccggggcatgctcgccgtacatgggtatgtatgtgcccgtaccttcttgtccgaacctacccacgacttccacttgcttaagagcatcataggtggaaccggctgttatatttgccagttctgtttgggcattagctatgagagctatacgtttgtatctgcccgcaataacgggcacagagaagtatttcgtatccgaagagcctgaaagtgtatgcaacgagctgcccagaatatcatatttcaccttgactttctccgtaccgccttcatcggcaaacatcagtacggtaatctctgttatccctttctcgtctacaccacgagtattcgccgcccggaaatcgggaatcctgacagaaagtgtcacttcggccgtctcacctttgccggacacgggcggaacaggaagaatgagttcgtcttgccggcacgaaagtacgagcggcagtaataacaggaccgacagcaggttgcggaacggtatgatgattgaactacttggcataatatattgttttatgatttgcatttcatgattgaccggtgcgttttttacactcctccgggttttacattctgattttcccaattcctgatcgttattttcgcatgaccgtttgtaaaggtaatctcgataggaatggttacttcaatatcttcctccatcggtatgtggtagcgggcaataagccctgccaacgaaatcgggggcacgatatggtttcccgtggtgggatcgataatttccaccatgccgggggtatcggccttgaaacgggggatgtcagtcgtggcattagcatggcggttggtgacatcatatgctacggcaggctggaatgtcttgttccggcttacggactggagacgccatgtgcccgaggtttcgtcgaacaccggtcgcaaggctgactccatgcccgtgatgtgtaccacaggctgcacgctcacaccatcaaggtgaagacttacacggatagtgccggggctgaaattgacagtatggtctccagtctcgtgctcactgaccgtaagtggcgtgacagcgaaaagaagccgatcaagcgtggggatggaagcggaagtctccgcatgcgggtgtgaggcggaaaggttccttatggtttctccttcggaaaagccgccgagcttggtctgtgcatccgaagcattcgcccagagcacgacagtgtagtttccctgcggcagatacatctcaacaccctgcaaacggtcaagttcactcttctccagcgtctgcatatgctcaatactgccatcgggacggtacacacacagcctcaccctctgaacacgctctccgaaaaggtcagcggcagagccgcgaggcttgtaggtaaatcgtaacagggtatccagagggcagccctccagggactccctgatgcacctcgacaagactaaggttaaaataccggaaagcatcaggaagcgtatagctttatacaatttcatgcgtagtatcttttaggtgaataactgtggttatgactttatatgaatatacgtgttatgatttaacaggttatagaaatacaggtcgtgaggtcagggcaaaagacacccacgacctgcttacattccgccgtgcgagaggaactggtgaactagtaaaatgagctaaaaatctcctctacgcaaacggacttgtaaaagaaacaaacaaatacaatataccttgatggtatgacagttagagattaggcttgacaggaacgaccgtccaggcttttaccgtcaccttcaaccaaacgctgacagcactggtattaggtattgtggaaaggttgctctcgtcaaatgtaaagtcggctttcgagatagtataaatctttcctttttccagttctacaatattgccactgccatctttgaatcctctcacggtgataaactggtcacctgtgccgaaattcacgctgctgccggccttagcagccaaattactcaacttaaatacgagctggagttgctcgttcgcgtcagtactgttaccgttaggaacaacctgatatgcccaacgttgccctgcagttggcggaatgacttcctttgggatacctgtagcagcgacggcagactggtcaaagagttttccagcgttagcaggggtgtaaagcccctgtccttgagcataggcagcaggagtagcaccatattgtactttcgttcccacaacggtaccggccaggttgaacttttcaaagaagttattcacatagattccttccagcgtaaaaccatccaccgcactggaggccgtagtcgccagaccttcgatttcgacacgtgccacggcaggaccgatttccacttcggcatacttgtcaccgtccgttattccaggggcataaggcagggccggactaccggtagtccatgtctgcaggggtttgtcatcgccgctcaacaccacatccgcaactgcagactggcttgtgatttccagttgtacagctttcaatgcagctacggttccacctgtaggcaatgaagttccggcaggaatattaccacataccgttacagtggtagccgccgcgggtacatccgttatttgggtaccggtagtcagattcgcaatcgtgatgggagtggttgtagtcgcgttcacatatttcagaatgctggtcccgtcatggaagtatacatgcagattacttaccgtagcaaccgttcccgaggctacaggaggctcggtcgatctcgtcagcgtcggcaactccagcttcatgaatacgcttctcgcttccccgttctttacgtcaggcacttcgatgtcatcgttactgcacgcggtgaatgctgcagccatagcaaccattgtaaacacgcttaacaaactttttttcataatcattgtaattaaattgttaataaaaaaataaacactaataaaacacttgttaatatttaattcgtacttatactttttttcctgttttgttctttctactttttactatttcccttccgctatcctgtccagttccatacggagcccgaagaacttgggaatgaggtccgacagttccggatccaggggaatacgcaggacaagattgggattcatgcggcaggccgcaagcatatgttccactgctaagtaatcatcgccctgccgggcgcttaccacagcatgcaggtattccttgcgggaatctacgggtaactggtctaaaagagcggaagcctctttatgataaccgagctgtgtcaggcaaagggcggtgttatagtcaggccgtttttccaatatcggcaaggcttgccggtattgtcgctctgaaaggagccgcaaggcttcggcatactcttctccctgcggagtatatacgggaccgcttgccgcaagagagtctgtctccgcagaagctatgacatattggtccagagcggaacggtcaaccaggtcgctaagcgaggccacaatgaagagcagcgtgtccgaggcggcaggccgccatgtgctgcggtcggtggcttccacgatagactctagccgcacacggagctttttcattccatcggtgacgggcagagaatatacatagttgtagatataatcatgtccggaaactgaatccgaattctggcggaccatcacggagtcgatataggggaagggaatcatacgccggcggatttcatcacggttacggtcattcatctcattttcggcaatccggtcgtagaaataacggtggcgggagatgtccatcgaatcggtggcggtgaggacatagttgtgtatgttggacaggctgcgcccccccgttataaaggtcacggaatttcgaaggtacacgatcggcggtaagctcgcgttccagccggtacatcggccaaaaggaggccgtacgatgatatttacggtcataggaggcccacaacccgagcgtgtcacgaccagccacatagcgccgtacgctttcttcgatccgcttgcgttccaggcggtgacggagtgtcgcacggttggcctgcgtacgcgtgttccagaaattctggcgttcaagggcaaggcgtttccacttctcgtaggcaagctgacggtcgcgctccttgccgtaaagttcatagaagaacctctgccggcaggcgatatccttattgatgcctttacggtcaagatacacactatcataagccgaaggatcgacaattccattaagaaacagcctgtacgccttatagtccgcttcctgcatgcgggtaaaggaagaaccggaaagcacaacaggtggtagcgggaagcctgaactgtcagaggtgcagagcatcggggtgagtgtgacacgccagcaactgtcaatcaggagggaagggacatggatattgaattccaaacgcacggaaccttcccgcatggtgacctgcttgacgaccgtgcgtgcagcgacgatgtcaacaccgcccaggtgtatggttttccatacgtcatccgtactgtcggagacctcttcgaactcaccgggaagagtgtccgaagaagtggtgaaccccacctgttcggcaagcactccggaaggtgcgctctcctcgtggggaagaaaaatattaggacggccggactgcataaacagccgcatagtccgcggttcgcgggaagtggaacaggacacggccagtaacactcccgcgcagaaagcggcggccgttatgtgggatttgagatacttattcatcattcaactttttatatcttgtttcaacagataagatggtttcagaaaagataaaccagattaacggcggtacgtgtgggtgtcacatagacaccggagcccttgccggtacgcttaccgcagttcacgcaacggtaacgttcccagtcggcccagacaacaccgagacccagttcgaactccagattccagcgacgcgaaagggggcgcaccagccccgcagaaagcccgccgccgaaagctgtgccttcgtaacggtagcgatgtccgaacagaccacccgcattatatatggagaacacaccgtggagcccgataaaacaaccccttccgtaagtttcgcgcatccaataacgcacaccaggctggactgtgaagtttttaagcttgccgtcatcccaaagacggaaaggattgtactgtacgggaagatgggcggaccaatgcgtggaaaaagccatggaaccctccacattcagattccccgtacctaaacccaccagattggttctgacagaataaaactgcgcggaaaccttgtctgaatacacaaggcaggccaagacacaggcaaaacataaaaagtacttttttctattcaaattcataattcaaactaggataactcaaactttaagtggataaacaaaacatgcacccaaagtaaacggatgaaaagctgtgtcatcataataagactgttcttattctacgtgcaacctgtaaaaatgaagtattttaatgaacaagaaacagttttatattatcacatctgttttgtttttcctagttgcaaaagtaataacacataaatcacgagttacaaaatgaaaccacaaatctaacgtccgcattgcataaaacattataatacaaaaacataaagacttcgttcttcttatttttctaacacgacgctaacagatgatttacaaccttaaaaaatatagggcaatcaataagtttctgacaattgactggaatagtaacagatattataatgaaagcatcttcatactttccggacatacctcccaggagaattaaacctgttatggcttacctccatgacaaaaccattctacaattacatcattccggtattatggcaaaaacaatctgaacatattctagatttaattaccggatgatgcattagtcattggaacctagtataaagttgaaatacctatcccagaaggcttaagaataattctttattagctgtttccgtagatttaatacgtgatttgagccgtgacttgcgagcgtatacattagccaccgtatccttcatgaataagctaattacttgcggtgaaaatcctacaaaaatatagcataataacctggtgtcggaagctttcatagttggaaaatcttccttgagcttgtacatggcattgtcatgacaagtgtttacgattttttccagttcttgcagtatgccattgttttctgcaaaatctgtaattatctgctttacttcattaaatatgactgactgttgcgatgttgtattttcacgttcatagtaggtctttccaagtttatcgacaatgtcaaagcgtgaagcagccaatcctcttaaataactttccgtagtctgctgttttttcacgcgttcagtaagagccttgtactcggaattggctttctctgtcaataacaaataatggttggtacgatcacgttgcatgcgtaaacgttggcggacgatataccaggcaattccaataataaaaaaggtagcggctgctatagctatttcccagacagtccggtttttcattctgtattgggcgaattttgttcgctctttaaaatagtcccgctcgaccataccggcggagaattgcatgtttgagcgcattattgaatcgttcaagtagatatagcgatgtacattgtccgttgctttttcaaaatttttagcctgcgcttcgatatggtatgcagtgtattgtagttctgccatgtcgcaaatatcagtagtgtgcgcctttgcaagctccagataataccgtgcactgtctatatgattcttcaaaagacttacatctgtcaatgtgtgatatccatataccgtatcctgtcgggcggaaagttcgattcgctgtaacaggtcattggatatatgccgtttggatatcacatatagtgatgcaagattagtaaggctgacttctatcagattactgttattatgttcatcggccaagtcaagagccgccgaatacagccttattgctttttctatatcttttgagtgaaaagtagcggctgccatgtcaagggttgcctttgtctcctcctggatatcacccgattggcggaaattatttctggcttcgtggaaataatgatatgcccggctgtagttcatttgtttataatatacttcaccgatctgtctgtataaaagccctttgtaataagattcatcggtatctgtcagtttcttttctattttgagaaaaagacgtaatgctcccagtttatcacctgtgcgtaatttaattcttccccaataatatagagttttacactggtgacgtaaatctttggggtaatgtttataatattgccaagcctggcggatcaatgaatcgtcagtaactttcatttgttttttttccaaagcttcggaatagagcaatgcatatctggcctgttcagcccggttgccttctggtttgagtttttgtagtattgctaatgcactatccgggttgttctgcattagcttttcagcctcactaaggcgaggggtctgttccctgttataacaacctgtaaaatagagaatagctgatagtccaattataattttatatttcatattgcgaatattaggagtaacaaacacatttcgatgcggaaagcttttattagaagaaatataattattattacattctttgtatctcaacagaaaccataaatactttttttgcatgattccctgcatgatagttctcaattcctatatataccatttccaaaaacagacaataaccaaaaagttataaaatatgcaggcttgggagtttagtattcttcatcttattatcaactttaattatgcgctgctttataccataatgtattttctttcagcacagtcataggattgtcactcggatcggatgttgttataccggaaaatgtattgataggaataatacctttggccatagtgtagaaattttttgtatgggttttatatggaacaagatgatttagctgctctctaaattggtttaataatataggatcgttacagagtgaggttatataatctgcaaaatcataaaatattacaggagtataaccatctaaacgttggattgttcccctcagggatttgtcaaaagaatatttactattgatactttttatgatggctgccatattctccagttctgaacagtccgttactgctaatgtcccacaaggcattatttcataggttgaataaaaattgtaaaattcttcacatcccgattgataatcgggattccccagtaaatattccccaatagcggcataaggcattccgtatgccatcatctcactggtagaaccaatcaaatattttgtaacatcctttaattcataggcaacctctatagatgacatataacagtcatcaaatagaatatattccattttcatgcctgcattagcaataccggaggctagagattttatatctgtttggtattcggcggtcagtcctccaaaataacgtgtcaatggaacaccctgatattcccaatgcattttcatgtgaggtgcggaacgcactttcatctcataaacaggaagccatcccataccgtgacatcctataatcatggtataaacagaagccggagcaaatgcctttacatcatttaaaattgctgttatcccatcgattgtcgtaaaaggcggagacttatattttttaagtatttcacgtttacatctcccgtgagaagacacaatttcaaacatcatggcctccgtactaccggtagaaataaaaacaattactttctcattgttcagccctattttcgttatacatttttccaggtcagatatgttattataaaaatagttcgtcaaatttgaggaccatggcaaatacatgaataatgttttccggttggcttctatcttttgattttcctccttctcgcatgaagaaaaaagtaaaattcctcccaataaaaagataatgctaacctttacgtagatttttttcgttgttttcatcctgcaaattgtccaataactcattattacttttttattatagccttccattgtaaaatctctattttatcttaaatgtgaattgtaaataaccatttcctgatattcatagaatcaaatcctcttataatcttacaatattatgactcattatctcacaatatattgaatattctaataaacagcatgaatttaatcgtttataacacgagatgattttcttttcaatgccctatggcagttctcattggagacactgccgaatggcacttgtttccgtttcattcttgcaaaaaaagatgaaacggtttaacaggaacaactgcctgttgaaacaataccggcaccaatgtcacaacaggcagttttatggttacttatggcagtccaaaccgattttcaaagccaaatcgctccggcttccacatcccctgacttataagtgtaaattataaactcttcaagcgcttctttccatgtaagattgaaggttcccataattgaatgtatggcacgattacttttttcatcaagcccgtcttcttccaccccttcggggttcgtgtcttcgtctacccccacagtctcttcacggctccagaacaccactaccggaatgtttaggttgatatcccatgtaccacgctggatcaatattccggaaggtttatagaacggatcaaaagtacctgtttccggattgcccttggatttgtagccgtgataaagacgaattttcaggtcgaattccttacggtctttcaaaaaacggataactcctttcaaacctatcgggttactgtctcctgttatttcagcttccttgctatgtttggtcttgtcccagggggtagtgtccacataaagataatccaccaatttctgcggttcattgtcatcggcttccggctgaccgtcaaatgtgggttttacattttcaggcgtgaagaaatgttgatgaatattatcctgcccgttttctataaactggctgttcatcaaatctcctttggcgttatagtaatagatgaacatcaaataaacgggagccggggtgtatttcccataagtatagtagtctccatttttctgcacgtagaacttgctttgactgccttcggcaagcctccaacccttgccggctttcagctcataagttatttcctgaatacgtttcatgtgcttggccggagattccggattctggtgaggtccaccgactttctgtatttcattccagtctgcatgcaggtgacattccacaagacggatagtcattttggaaggatcttcatgcaatttattatctgtctcattttcaggaattacaggatctttactgcatgaattgaacaacaacgaaagagctgttcctatcaggaacatcaatgcgattttacatacatttgttttcattttttatttatttggttaataataattgttataaatcaaaaactccagttcactacacaacgtacatcagatcccatgtcatgtgcatagtagcgtgaacggttagtgtattctttatattctttgttcaagatattgtctgccgctatcatgaattgtagtttgtatccgtattttacaggacactcaaagctagcagcgaaccccaagaggtggtatgccggaggggtatagggaataagatccgtattcgagtcaaaccgggtctgttttgccacgaatcgatgtctgatactcaaacgtaatttggaatgcgatttggtttcgtgaagccatgagaggtcatggctgaaacgggaagaggggatataaggaaggtaatttcctgtcgtctgttcatttgcccgtataaaagaagcaatcaggtgataatcccatgaatttatgggcatgaagtgaaagtcaaaatccattccgcgaaagaaagccggggtctgtttgtattggaatacagggtatacccccgaaataacagtgatggtttctttcttcggttcatcatagatatagccgcttatccattgcaggtaaccgtccattcgggcactgaataccttattgctgtaactgatggaagatatccatttatagctcctttcggagtgcatggtagaatctcctttgacaaacattccggatccgagttcatttccgttgctatataattcatacacgtgaggagctctccaggccagcccgaaattagtggtgagcttccattggtcagagaaatgatgatgacctcccagactgtatgatacgttattgaactttcttgttcctccatagagacttcctgtccagtcataaccactggcacgggtttcctgtccgtcaaaacgaatacctgcttcaattcctcctttactgtaattatacttcccgataccatatattcccatctgtgtctccgtatagttgggaataacgggaacaatacctgttcctgcctgactgtgattatcaatgaacataatttgtcccccaacctctgtttgccatgaattataattcaatttccagcagagagagttttgtaatgagtttaagtgcagggaaacagctggaatgtcggaacccagacgccggatgcggttttcctgtcggtcgtccttctgccaggaactttgccagtaaagatttcctgcgttccgcatactgaacttcattttaccaatggctgtctgatgggtaactttttgatatgggtatgcgatacttcgcgtgaaaggatctgtgtacaggggacgtcccaatcggatacgttctgccagcagatcttcacttcccatctgggcactgaacattactcccgtccggttgtaaaagtgactgtagaatccttctattcttaaacgtccacggtcatagccgagtaaagcggaggtatgatgttctctggctccagtgttatttagaagatagtttgcggtggaacggtctccggaatttgaatatgtcccctgtactcgccaggcaaggtcacggagaaaagggaaagtgccttccaactgtccggtcagcacataacggtgaccattacttccataaagtatggaagtctttcctttcaaggccttcttccggaagggtaagggagcctgttccatgacaataattcctcccaaagcttctgaaccatatcgtaccgcgtcagaaccttttatcacccgaatggaagcgtttccgttcatatccacttcaggagcatgatcaactccccattgttggcctgtctggcgggaaccattgtttatgattaatatccggttgccatacattccttggatgacaggtttggcaactgtcgtccccgtactgatggaacttacgccactgacctgttcaagcagagaggtgagagaagttcccaatgcgcgattgattgcgaaggaagtaaggttgttgcttaccgtattccgagtcactccggagcactcaccggtaataatgacttcttccagaatttttatctccggataaagatatactgtttgaatattcacctttttgaatgcctcactcaaatatatatattgagatttgtagcccaaactctgtacaagaactgtatccttggaatttgtcttccaagggataatgattcttcctccggttgaactggcaaggggttgattctccaataagatgtaagctccttcaatcggacgtccggtttccttatctacaaccaacagtgtcctatgtgtatctgattgctgtcggtatttctgtgcatacatccttgtaggagatattgcacacagccagacaatgaatagacacacatattggaaatatgcatgaaatgtcatactttacgaaaattgtaatgaagttataaattgtttaagataaccaaagggcacagcatccctctttcacatgtcatcttataatgcatgcaacccatgagagggattgtaatagttggacaggaggagcgcggagagacaataggggaaaagtaacagtaatgtccttctccttttggataagatattcaacggggttctctgtctgaacgcaattgtactcaaagctctcggcttcggtaaatgaagataaagtgaacaggcagatagcacatttatcggcagaatcatgatgggaagattgttgctcatcatgagatatacataaatcttctttgtgaacatgaaaggctttcacaaagaagaaaggcatcatagtcagcaacaataagcatgccactatggctctgtatttccgcttttttcttgcattatccattaggttgtaaagatagcagattgcataattgtacgcaatacctataaatgatgattttacgatcaagtacgattaaatatattgtcccgattattttgatatgggaatcaaataaatcgacacatcgttaccggctgtatgataacaggctataataaatcttcctatttttattcctgttcatattggagggcctgtgtaagatgccccctaaaaccaaaatgattcttctcccagaaaatattcagtaatgatctcttgataagttttgaccgatgagcattattattttaaaatcaagtacttcgattctcatataattgtttttaaattcgtttaaaattgaacggtgtccaattgttacgataatacttcagttcacgttgatatttcgaggacgcaaagtacggctcattcccaaagcataagagaaaggattgatgtcgaaatcgcgttcaaatgttccggttaccatattctttctttgcggaagtgtacctggaaagttttggttacgccaatttccttgtacagatatgccagcttttatcttgtcttcattccaatagaaagatttttttatatttattggtcgagagaggctactactaccctcctgaagttagtaaacggaatcattttttacttcctctttttttcttattgttgtgcattaataaataaagctcttgcaagaaaaaaaaggaatatttttgtcttagatatcattgtgaatttcaatttaaatataaacacaatattggaccggatcaatttgtcacaaatcattttataacgaagaaggtatgtgtatggacatattaaaaagaatagcgtcactcgtcaataccaaatcattagcaccaatcatttgaaaaacaatatacaaaaaacgctttccgccaatctcctttaattgggcggagttaagttcaaatcttacattatccaaatatatatcctttacagaagaaaagagaccattcaagacgttcttgctccatttattcttttcccattgcaatgaatcatgatccttaattacaaattccacatactgtatccatctatctatagaattggaaaacttatttttcacatcaccataattactattcttaagtttatttttcacaaactcatgcaaatccggtgttgagtaggctatcaactcattcttcaattcacttaagggtttaaaaccggtgaatattttatcaaattctgcaagcaacaagccaccattaccctttgcatacatgcttaaatgtagtgtaagcatgttgcctgtgtcgcttttttctttcagagttgtactgatttccacagcatacgcactttcatcatatgaaaaaatgtgaccattaaatagagatggattttcatatatccctctcatatacttctgttttataaaatctgtatttacagtaacctttccttcataatatttattcttgtcaaacagaagtgatattctttttttagacctactattattgtacctaagatagaaagaaagctgattttgctcatattttatatcttcaagaaccgtcttctcaagatcttccagagtaaaaagatatttttctccccctacatttatagaataaaagtccactaaccggcctaaattctcaattgtaaacatgttcactttatgtaatctgtaaaagctatcaaaatcaagctttgcataataatcagcatttgctttccactcagcttgtgcaccattaaccatttgataatcgtcaggtttgctcacaaagccggtaaaagtgaattcattcttaaaaggtgaaccatttaccgtgcctgtaacatatagcacaaatgagcctttttgataatctttccttttcactacagcctcagttatttttatcattttcccgtttatctgcagcgtctctttctgtgcttcaacaagtcctaacgcaacatttatatctctagacatatcaaatctaaaataagctgcaacatcctctttagccacagcgggaactgatccggattgttcactatgagattcttcctgttgcctgggatgtcgattccgggattcaatcggatcattctcaccacaagcaactaataacattatacagacaagaaataataggcacctttttatgttaaaatttcctaccttaaacaaatcacatgtcctatcacacataaacattactgtcttttcaatatatattgtgctgcgagccgcccgctattgttgaagatttccgtactgtcagacaagaccactgcgtcgtcgagaactttataatatgttttggcacccgatgaaggagtaaccagttcaatgatgttttcgcctatcatattatatacaccgctctcttcaaaaataccattctcctcacccagatactcactccgcaaatcataagttgcatcactattaattttcaatgtcgttttgatgccaccacagtcggcacaaggtaatatgccttcataggtgccataacaatctttgtttttgctatccactactccggcagcactattttcttgttgtttatatttcttcccagatccaacacagcctgatgttactattatcatggctgctaccaataaatgcaatttaatcaatttcataatttaaaatatttaacatataatttgaggttaattataactcgcaagatcattatatacaaagacttattgtaaatgcatagcagtatataacgaaattatcttcgtctcactcgctatgcattacaataaaattagaaaaaaaagaaaactatttaaccgtcacattgatagttcccgttttcttatccttatctgtaactgtaatagtagtttttcctgccttaactcctcttatgttgactttattttccttgactgataccgtagcaatattgacatctttcgcaacggcagaatatggctgtgcaccaccttttactgttactataccatcttttccaacactcacagtaatagattgtttatcaaaatccagtccttttggagtttttggggtctcttttacagttcttacagttacagcaacttttcctgtaactcccttccggtccgtaatagttatcattgctgaaccatcttttacaccggtaattacaatcgcatttttatctgatttcgcaactgcgatttttgcatcacttgatttcgtcgtatatggtgcagtaccattactaacagacacagtaaccgttttaccaactgcaacttctactttattaggactgatttttaaattgggcttatcatcatccttatcacatgataccaatacaaaagaagttaagcaacaaatcactaatgccatcgattttaaaaaaggtttagttttcatttttgataaatttaaattaatagataaaatgctaatgagtactcataaataaaaaagtcagatttttcttactttttctttgccagcaaaaataataaagcgaaattgtatttgaattataaaatgattttaaaaatctaacacctcaattcatatacatctaacaatcaacaccttagtgttatgaaacattattttatctcacattgaactaacatctgttcgaaaagcataaaaaaacaatattattccaatatcaaacttaaaaaaatatgtttcacattgctaattctgattatatggtcaatcttcataatagagtgatacactattataacaccgactgttacagtatccctaacagtgtttgaaaaagaccctttttatgatatttcacaaataccatatattccctataatattattcttaattagtgaatgagccattcaaagtaaaaattgaatgtatttttagcatattctataaaaatcaagaaaggatggccaattcaaaaagtattttatccaacaaacggaacattctttttacaagttgaaggtggtatcactcaactataattgtggatgatcaaaaacgtgtgttcaaaccatacacaataaatcttctatagcacaagatttcttgaacagcaagagataggtactcgcaagtccacgacaaaacgttttccgaggggatactgacgaacttaaggatattgaaatgaggtaccatacaaaagtcggttgttgtcaccaatattatcttaaaataactcatctacaaaagctatgtgttgtgacatcgtattgttaaaaaaacattgtcataaacgtctgacgtctcttgatagatttacttttagagggtatcatatagctatcttccatatcgtttcgagtcgctttctgtactcatttgatatcattcaggccatactcttgaacattcactcatgcaataggggcacttaagttctaataaatagattatctcgctagcagtctcatctctcaccacacagctagatttattataaagttaaattcaatgctcgtgcaaacggctgtttgttctgatttaatgtactctttgtttgaaggcacaaagatataatgagtatctaatattcaaataaactttgttttaagactttttatgacacaaacaaatacgaatgatttgaaaaataaattgattctctttcataagatgttctttcctataagttaataaaaaaaacactttatataattttttttctcttcattttttcgaaaagccccagtcttccattttttatagaatatcatttacatattcctattttttccatccatgcattatatacctcatttttaggtgaagttcacccactctctcctcttattttagtcagattatgctgccgttctttttttttcttcgtgaccttttcaatcatacataccgcattgaacgtatgtactccaaagaaaatccaaaatatttccacttccctgtttctggctttttattctggtctgtaaataatattatttctacattttaaaacttcctttcaatctggtagcactttcatggctgagttctgaccatcaaatcttacgaaatggagcaatttagatagctcagaccttgtacttaaagaagtattttgtaaaactttttaaattgatattattagtgtagcttgaatccgcagcaagtaccttaatcctaactttgatcagttgttgtaaatgaatacagtctttcaaatgtattacttcgttaaaagccgtaaaggagatatgttctataaaggagatttcatctatctgtatactgttgactttgcctccgaattaaacggatttgttttttcttgccttaataatagtctggagggactaaatattaaggaaatttgctaattactgacgaatcacattaacgatttaggattggttagtgaatgaagaggggcaatctgaacaccactaaataactggtaacgaatattactagttaaatatttaatcagttatgaatatgaaaagttgatataggacttcaagactaccaaggccattttattttcaggagaaaaaaataacttttacccccccccaaaaaaaaaggagaggatgtcaagcatctgttgggttattcccaagaaagtgaacagagtatggaagctgctgatttattcgttacaactttgacgataatttttaagcatatcgagcggtgtaaaatctacctaaacaaaacacgatttcttttatatctttatcgtgtatttttattttagattttcatcggttggatttaaccgattgaagaataaacttttagcagagtatttgagaaatagaggtaacgaattagcaaccgtgcaaatttcagcgatttgcggtgctatgttgtcaaataactctttgtaaatacaaataaaatatttagtacaattttgaagacatcattaataaccttatttatatccatacacctttggtttgtttccctatatttattgataatcttttattcacatatttggtaaatatttcaatctacgtagattttataactaatagagtataaacaatacaagctattccaacaaataaagctacggcagagcatttggtaaatattgtatctttatttttaataccatacataagcccaataatagcacataaaggaataccgacaggaataatcgtcagaaaccaaatgagtattttatgatacccattgctgttaatactttgtttttcaaattactcatagctaccattctcattgcttgttactcttcgcatctctttctttattcatcaaccgccaaatagctttctgatatttcaacttggcgaacatctcgtcatcttggttatctatctttaaggtcattacccgaatacttggggcagtgggatatcggcttctcactatatcatccactagaaacccgcatagtccggtagccggttctgtaaacaagaaaccttgaaacatgagattaatatagtctgcattttcgcaaagatacgccttgtacctcttatatgtatccaacttcatataatcttctgcacggctgctgaaatttggcttggcaatttcttcgcataaggcagattctaatttgctgtaggtggcagtatctaaatctccccaccaataatgatcttcgggattgaccgacatatccacccattcagaagcctcccagtagtctatcgcaaacacaattgaatcggctttctctttggatgagtaatagatggaatctttctcccaacctttgaatatactttcaatagaatctattttctctttcctaattttattatatatgttttttaaatcgtagccatgaggtaacgatatttgaaaaacaccgttttcaattcttgcattcacctttggatttgtgattaccgtatcgtcaagtacaaaagctatatgtttgccaattgccttttctgtttcttttgcccatttttttagtttatgcttgcttatttgccccacaattacgcatgtcccattttcatcagaatccattcgtaacgaaacaaaatcttttactgttacaatagactctttagcaatactgtctttttgctgtgataggatgtgataccatccattctcatagtgggttttatgtatttgattacaggaagcgaaataagcaattaaaataagtattccgaataaattctttttttgcatgttcttatataataaaaaaataaactgttatctgttcctgaattgtatccgtcagatatatttaaagcattatgtttcaaattagctacttctccaaatatataagcaaaagtagattgtttgcctttttaagaagactgttcaaatctgttttgatattgtttttcttgatcacaacttataagatggattgtgtatagttatttcatctcgccaagcatattccttgttttatccatataattactgaaatgcgcctttacctgtcaaaaatatattaccgtaaataatgtaccgttttatcccaaaagatttaaaaacagttctttatttactatttttgcagatttgatacgtgatttgagccgtgattttcgagcatatacgttagccaccgtatccttcatgaataagctaattacttgtggtgagaatcctacaaaaatatagcataacagcctggtgtcagaagttttcatggtcggaaaatcttccttgagcttgtacatggcattgtcatgacaagtgtttacgattttttccaattcttgcagtatttcattgctttctgcaaaatctgtaattatctgctttacttcattaaatatgactgactgttgcgatgttgtattttcacgttcatagtaggtctttccaagtttatcgacaatgtcaaagcgtgaagcagccaatcctcttaaataactttccgtagtctgctgttctttcacgcgttcagtaagagccttgtactcggaattggctttctctgtcaataacaaataatggttggtacgatcacgttgcatgcgtaaacgttggcggacgatataccaggcaattccaataataaaaaaggtagcggctgctatagctatttcccagacagtccggtttttcattctgtattgggcgaattttgttcgctctttaaaatagtcccgctcgaccataccggcggagaattgcatgtttgagcgcattattgaatcgttcaagtagatatagcgatgtacattgtccgttgctttttcaaaatttttagcctgcgcttcgatatggtatgcagtgtattgtagttctgccatgtcgcaaatatcagtagtgtgcgcctttgcaagctccagataataccgtgcactgtctatatgattcttcaaaagacttacatctgtcaatgtgtgatatccatataccgtatcctgtcgggcggaaagttcgattcgctgtaacaggtcattggatatatgccgtttggatatcacatatagtgatgcaagattagtaaggctgacttctatcagattactgttattatgttcatcggccaagtcaagagccgccgaatacagccttattgctttttctatatcttttgagtgaaaagtagcggctgccatgtcaagggttgcctttgtctcctcctggatatcacccgattggcggaaattatttctggcttcgtggaaataatgatatgcccggctgtagttcatttgtttataatatacttcaccgatctgtctgtataaaagccctttgtaataagattcatcggtatctgtcagtttctcttctattttgagaaaaagacgtaatgctccaggtttatcacctgtgcgtaatttaattcttccccaataatatagagttttacactggtgacgtaaatctttggggtaatgtttataatattgccaagcctggcggatcaatgaatcgtcagtaactttcatttgttttttttccaaagcttcggaatagagcaatgcatatctggcctgttcagcccggttgccttctggtttgagtttttgtagtattgctaatgcactatccgggttgttctgcattagcttttcagcctcactaaggcgaggggtctgttccctgttataacaacctgtaaaatagagaatagctgatagtccaattataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctgttataacaacctgtaaaatagagaatagctgatagtccaattataatcttacatttcatattgcgaatataataatgtgttttattttttgcatgggcgattaggaatattttaccaatataaattattctttaacttatatgattatcgctcgctatttatatatattttttattgggcctaacaatatataattgcttattagcatattatataatatgtataatcgtaatagtacaaaatagcagtaagttattgctattcagagtaaaagtatcagttcactcgttgttgttaaaaaataaacttgactaccctaaaggtgtaagtgtaagtgcttttttgaattttatcaagggtgttagatatgtgttagattattaattgaaccatttttgcaaactactgattataagtaaaataaaaatcaatgtattagatttattcttttgtcctacaactaaaaagctctgcaatctttttacttttgcattcgaaaaaaataaaacaatagattatgaagaaaattgctattttattagtttttactttgggaacatttattgtaaatgcccaatcagttgtagaaggaacaaagtttatggacaattggtctgtaggagtgaatgcaggaacagttacccctctcactcacgcctctttctttaaagggatgcgtcccggtttcggagttggaatatccaaacaattaactcctagttttcggtttggaatttcagggaatgggatatatcaatacaactccgagtaaaacagcttttgatgttttagatgtcagcttgttaagtaaaattaacttaataaatctatttgcaagctatcggggcaaacctcgtttgtttgagatagaagctattgccggaatggggtggttgcattattatgtaaatggtaaaggagatgacaattcatggtctacccgtctcggattgaatcttaatttcaacctcggtgaaacaaaagcatggacattgggaattaagcccgctatcgtatatgatatgcaaggtgattttaatcaggcaaagagtcgtttcaatgcaaacaatgcaacatttgaactgactgccggattgacttatcacttcaagatgagtactgggaatcattactttactaaagtaaaagtctacaatcagagcgaaattgatgatttgaatgttgctattaatgcacttcgcgaacaggtgggcagtcgtgacagagaactaaacaatgctaaccaaagaattagcggtttgcataaagagttggaagaatgtcgtacaaaggtcgttcccattgaaacagtagtcaagactgcccgcgttccggaatctatcattactttcagacaaggtcgctcatcagtggatgcatcacagctaccgaatgtggaacgtgtagcctcctacatgaagaaatatcccgattcaaaagtcattattaaagggtacgcttctccagaaggcaatgttgagatcaacgcaaaaattgctaccgcacgtgcagaagctgtaaaaacaatccttgttaataaatacaagattaatacgtctcgtattactgccgaagatcagggagtaggtgacatgtttaccgaaccggattggaaccgtgtaagtgtatgtactatcgaagattgatgtaataagaatatttggagttgttgaaggtaaataaaaaaggaagcccgaaatctgagggcactgaaaaagttctttttctccgttagctcctcttcttatgaattggctccaaagttgcatggcgtatgataaatttcatttgcatgcaacttttccttatattggtagtgagtaatcgtctattggtatacatgcacgctggcaacgacactctcaaaggagactttgaaagaatgcaacttcagtccgcttttcccatctgctccgactacggctcggaggctatcgtccttctgatctttgaccaaaagaacttcttggtctttgatttttttgctcatattactatgtatttaatgacgtcagtagcggtttacagacaaaagtaaacaaaaaaaagtgagtgctagagattgtaaataagtgagtatttgtagctttgatatgattaggagtagcatattgaaagttataaatttcatttgctgaattaccataaatggggaatggtaagtaaaaaaatcatcattttaaggtattgcaaccgaaaaaatatgtgactaattttgcgttataaaataaagaattatgttctgacctatgcaaacaacgaaggattatatacgtaagctattgctggaaacagcgcagaaagcttttttcgaaaagggcttcaagtcggtgtctatgcgtgagatttctaagttgtcgggcattggtctgagcaatatatacaattactatccctgtaaggacgatttactggttgatgtgttgcgtcctcttttggctgctatgtacaggatgctggaagatcacaaccgaccggagaatttctcccttgacatatttatctcagatgaatatcatcgtgcatctttgcaggagcttatgggcattataactcgttaccgaagtgaattaaatttgctgtttttctctacgcagcattctcgcctcaaagattatttggaagagtggattgagaagagtgccacaatagggatggaatatatggaaaagatgagaagactccatccggaactacataccgatatttctccgttcttcatgcacttcacctgctcttggtggattaatatgatgaaagaggtggtgcaacataaggaactttcctgcgaagagatagagtgtttcatcagtgagtatattcgctttagcacgggaggatggaagaaactcatgaatgtaaagaatgaaagatgaaggcagaactattgaaacatcctgtctgtcaagagataactaatcaaaacatccgtttctcgtcttgtctgcaatgcaagccttgcggaaatgattgtacgattgtaaacaatcgaatctcttttgtatttgattccgagacaataggcatcagctaccttctgctcgactccacacctatagcctgcatggacagatgctgcaatcttgtcaggcagcgtttcgtttgatgcaggagttggaacgccgagtcattccagaagaatcactaaataataatcagcatatgagtatcatcaacatcatcagcaacgacgaattaacactcgtacaaggagtcaacgggcttttcttctgcgaggagtcatgggttacgcaaagcagggcagtctcccgtatcggaaaggttttgcccaaagaaattattgggacgaaagatcaaagtaccaacatcgtacatccgcagactgaccgaactaaacttagttgccaaaagcatgaaacgtcttatttctaaatctaactgtttctcctaccgagcgagccgcctgcaaagagcggctcgctttgcttctgaacaaaacaaacttttgttctcttttgacgcactaacttccaatccatcatagccatgtctcaaccagtacttatagcatttttcctaacatcgtttgccggtatatccacagggataggcagtgcgattgcattttttgctaagcgcaccaatacttcattcctttctctttcattgggattttcaacagcagtaatgatttatatgtctttcgccaatctgtttgcctcttctttgcagactcttgccaatatacatggcaaggacgacggaactcttcattccacactttcttttttcgggggaatcgtattgattctacttattgataagctaattcctcactacgaaaatccacacgaaatgcatcgggtggaagaaatgagcttaaaggaagaacgaaagactgaaataaagcctcaattattacgcgtcgatgtagtgacagccttggtgctggcaatacacaatttcccggaaggtatggttacgtttcttgcagcattgaaggatataaacattgctatacctattgcctgtgccatcgccatacataatatacccgaaggcatttccgtctccgttccgatctattatgctacaggtaatcgtaaacgggccttttggctttcatttctatcgggattggccgagccggtaggagccgtcatcggctatcttatcttggcaccattcctcaatgaccatgttttcggcgttattttcgggatgattgccggtatcatggtatttatctcgcttgatgagttactacccgctgccgaagaatacggtaagcaccatcatactatctatggtttggtagcaggcatggcggttatggcactcaacctgctgatgttgtgttagcaagactaagtaatataaaaaacataagtaaaaaaaagaaagaatatgaacacttctcactcctgccgttgtcacgtgcatgatgcccacaaagagcattcttgtgtccacgcacattgtcaccattatcatatgtagccccaaagtggaaagctatttctcgtcacgctgctgaatgtgttgaaatgaatgaacttaccaataacaaacgatatgaaaatagaaagaatcaatgactggtttgcccgtcagggcagatggatggtacaaaaacgatggcttgtactaagcttgtttatcctcgtcttcgccataggatttacagggttaagatatttcaaggtgagtgcttcgtgggaaaactacttcctcgaagacgacccgatgcttgtcaagaccaaagaattcaaggatatattcggcaatgacaattttgccgccgtactgacccaatgcgacaattcgtttatgaaagagaacttagagctcatccgcgaactcacgaacgaaatgatggatagcatttcatacgccgacaaaatcacttcgctcactgacatcgaatttatggtagggaatgaagaaggaatgactatcgagcagatagtgcctgaccttattcccactgatgcggcaagtctggaaacgatacgtcgcaaagcctatatgaagccacatattgccgagcggcttgtctccaaagatggtacgctctcgtggattattctcaagttgcgtacctttcctaaagattcagtgtggaataaaggtaagaatgccgtttctcctgaagtgctaacggggaatgagctggagcatatcatcactaaagacaaataccaaaagctccatcccaaaggcacaggcttgccctacgttaccgccatgaagatgaaatggattggcaaagagatgccccgtgtgatgggcattgccgcactcgtttccattcttattttgttactcataacacgctccctacggggcgttgtcgttccacttatcacggcggcaggctcaattgtgattgtgtatggactgttgggatatgtcggcatgacgatagacagcggtatgatgatgatacctatgctgttggcgtttgccgtctcgatagcctataacatacatatcttttcctatttcaaacggcaattccttctacacggagaacgtcgacgagccgtagaagagaccgtgggtgaaatgggctggcctgtgttgttcagtgcactcaccacctttgccgccctgctgtcgtttctcgctattccgatgcagcccatgcggttcattggtatcgctacctcctcgtgcgtgatgctggctttcttcattgccattacactgatgcccgtgctgttgagttttggcaagaacggcaaacctcatcccaaagtgcaggaaaccggcggacggtggctcgaccatcaactggggcgtttgggagaaagcgtactccggcatggcacattgatcctatggattgcagggctgcttaccgcagcactcatttatcaattcaccaagatagagaccgcctttgacatagaacgcaccatgggacgtaaaatagcctatgtaaacaatctgctggaagtaggtgaaagcgaactgggatccatctacacctacgacgtcatgatagacctgcccgaagacggcttgacaaaatcgccggcaatgcttgtacgcttagactctctggcacaaaaggccgaaggctataagctaaccaagcgaacgactacagtgctgaatatcctaaaagacctgaatcaaaccctgcacgaaggagatgcggcttattatcgtattccgacgaatccggaagaggtggcacaactgctgctcctttacgagaatgcaggcggtagcgaagcggaatattggatcgattacgactatcgacgtttgcgcctgatggtggagatcagcagttttgactccggcgaggtagaacgagagttgaacgatattgcagccaatgccgccaggctcttccccgaagcttctgtcactacagtgggtagtattccgcaatttaccgtgatgatgcagtacgtggctcgcgggcagatggtttcatttgccatctctctccttattatcggcatcctaatgatgttggtctttggcagtgtacgcatcgggcttatcggtttgatacccaatatcactccggctttggtggtcggcggactgatgggatggctgggctacccgttggatatgatgaccgcaaccattatgccgatgatcctcggtttggctgtcgacgacaccattcacttcatcaaccacgggcatttggagttcgaccgtcgaggtaattatcgggatgccattctccgctcgttccgtacgatcgggacaccaatcattctgaccagtgtcgtgatatgtgcgaacttcgctatttacatgacttccgaaggcctctcttttatacacatgggtctgctctccgtagcgggtatcgtatcggcactcgtggccgacctctgcgttacacccgtgttattccaaaagttccggttattcgggaaagagatagaaaccaatgaaacaatcaattaatatgaatacattaaagaaacttcaattttacatgggcaaacgcaaggtgcttatgcccatagccctgacactgtcgggattaagcggtctgctctcgcttatgccgttcatcttcatttggcttatcgtacgctcgctactattgactggcagcgttgcctcaggaatccctatcaacgtctatgcatggtgggcggtaggcacagccgttgccggccttgtcatttactttgccgggctgatgcttttgcacttagcggcgttccgggtagaaaccaatatgcgacgtacggctatgagaaaaatcatgcagatgccgcttggcttcttcgaccggaataccagcggacagatgcgtaagattattgatgaaaatgcttctgaaacccacacgtttgtcgcacatctcttgcccgacctggcggggagttttatagccccgctgtcggttataatattgatcttcgtcttcaactggcaacttggtctggcgtgcctgatccccctcacggcggctgtcttcatcatgacacggatgaatacaactgctcagaaggcgttccaaaatgaatacctcggagcacaagagcatatgagcagcgaagcggtggaatacgtacgtggtatttcggtggtgaaagtgttccagcaaacgatattctctttcaaacgtttttacgacagcatcatcgcctaccgggatttagttaccaaatacacgctgggttggcaaaagccgatgtcactctacacggtggccatcaatagctttgctttcctacttgtccccgtagtcatattgcttatcggcaacaaaagcgaaaacattgcccccatcatcaccgatatgttcctgtatgtgctgattactccggtgatagcaaccaatgtgatgaaagtgatgtatctgcaacaagatatgtttctggcagatcaagccataagccgggtggaaaacctgacgagtagcgaaccactcccaatagccgaaaatccggagaaaatcaccgcttgcgatgtgacattcgagaacgtttcgtttgcctatcccaatgccggtcaaaatgccgtagacggtatcagcttccacctccccgaagggaagacttttgcccttgtggggcaatcgggaggagggaagaccaccattgcccaactcattccccgcttttgggacgtatcagcaggtagtgtgacgattggcggaataaatgtgaaaaacattgccaaagacaacctgatgaaccacatcgctttcgtcttccagaatacaaaactcttcaagacctctttgctggagaacatcaaatacggtaatccggcagcgagtgatgaagccgtgcaacgtgccatagacctttcccaaagtcgggagatcatcgaccggctacccaacggattgaacacgaagataggagtagatggaacattcctttcgggaggggaacagcaacgcattgtcttggcccgggccatcttgaaagatgcgccgattgttgtcctggacgaagcaacagcttttgccgaccccgaaaacgaacacctgatacaaaaagccctgcacgagctgagaaaaggaaagacagtgttgatgatcgcccatcatctgactagcgtacaggatgccgacaagatactggtgatagcacaaggcaagattgccgaagaaggcacacacagcgagttgatagcccgaaacggcatctataacagcatgtggaatgaatatcaacgaaccgtgacatggacggtataaacctcaggagacaacattatgaatattagtaaatattttcaacacagattcaccttatcggaagacggggcaaagacctttataaaaggggttatagcttctctttttctcaacctggcactgatgctgccggtaatcttcatctttctgttcatcaccgattacctgcaccctgttatccaagccgggaacagcacgacgcacgggctctggtactacgtgctgacggctctctgttttatgacggtactctttgtgattgcgatgatacagtacaagagcacctacacgaaaatctataccgagagtgccaaccgtcgtattggcattgccgagaagctgcgtaaattgcctttggctttcttcggagaaaagaatctttcggatctcaccgctacgatgatggaggattgtaacatgttggaaaccctcttctctcacacagttccacaactcttcgcctctgtcatcagcattatcttgattgccaccgggatgttcttctacaactggcaactggcccttgctctctttggggtcgtaccggtagcgacaacggtcatcttcttaggaaaaaggcttatggataaagctaataaggagtactatcacgtaaggcgtgatacgaccgagcagatacaggaagggcttgaagcggcgcaggagattaaatcgtacaacggagaggcagcctattgcgaccgtttagacaaacagctcgagatatatgaagccactctgcagcgaggcgaatttctcggagcggggcttgtgggcagtgcacagtctatcctgaaacttggtttggcaagcgttatcattgcgggagcttatttacttggtttgggcagcatcgacatgttcacttacttggtcttcctgctcgttgtagccagcatctacaaccccatcatggacgtgttcaaccatatggcgacactgatactactcgatgtgcgtatcgaccgcatacgtgagatgaacgacatgcccgcacagcaaggcgatgaggattgcacggtagagggttacgacatctgttttgacaaggtcgattttgcttacgagacaagcaagcaggtgctgcgcaacgtctctttcactgccaagcaaggcaaagtaacggcacttgtgggaccttcggggggaggcaaaagcacttcggcaaaattagctgcccgcttttgggatattcatggcggaaagatcacacttggcggacgggacatctcaaaaatagatcccgaaatgctcttgaaaaactatgccgtagtctttcaggacgtgttgcttttcaacgcttccgtcatggacaacatcaaaatcgggaagaaagacgctaccgaggaagaggtgaaagcggtagcacgtcttgcccgttgcgatgagttcatcgcccggctgcccaacggttacgacaccttgataggcgaaaacggagaatcgctatcgggaggcgaacgccaacgcatatccattgcccgtgcgcttctcaaagatgctcctgtcatcctcttggacgaagcaacggcaagtctggacgtagagaacgaaacgttgatacaggccggtatatcggagttgatcaagaacaagaccgtcgtcatcatcgcacaccgtatgcgcaccgttgccaacgctcatcatatcgtggtgctgaaagacggaaccgtcgcagaacaaggagcacccgacgaactgcttgcccgaaacggcgaatttgcccgcatggtagcacggcagaaggagaccggaatataaatcgaatcaatcagaatcaattataaagaaaaaggacaaatgaagagatcaatcgcagtagtagccatgcttgtggtggggttcgctgccacaacatgcgcacaaacgggcagagagattgcccaaaaggtaaaagaccgtcccgacggcgatacccgtcggtctgaaatggttatgacgttaatcaacaaacgcggagcggtgcgcgaacgcaagctcatttcctactccatcgatgtgggcaaagaaaagaaagaccgcaagagcatcatgttcttccaatatcccggcgatgtaaaggggacgggcttcttgacgtgggattatgatgagctaaacaaggacgatgacaaatggctctatctgcccgccataaagaaaacgcgccgtatcagcggttcgtctgccaagcaagactactttatgggtagcgactttacctacgacgacatgggcagccgcaacgtggacgaggatacgcacacgctcctgggcgaagaaaccgtcgacggacagaagtgctggaaactggaatccttgcctaaggacaagcgtgatatttactccaggaaaacggccctgatacgtcaggactgtctgatacctgtcagggtggaatattacgacaagatgggcaagctgcaccgtcgtctcgagatgtcggatattgccaaggtagagggcttctgggtagcccggaagatgcacatgaccaacgtgcaaaccgagcatcagacggttctcgaaatcaagaatccgacgtacaacattcccatggaggagagcaagtttaacgtgaccacgttagagaaaggcaggttctgatgaaagcgttcaatcgtctttccgcggggctttgcctctcggtctttctgttttgccccgtgcatggagtttggggacaaggagcgggcgaatcgtcgtggcagctcaaaggccttgtcgacacctaccacgccttccgctccgaaaagccgaacgattggatgtcttcccgtacccgactcaggggcgaggtcggcaaaaacttcgcaggctcttcgctcttcgtctcgttcaacgctacctacaacgccttgctgaaagagcgcaccggctttgaactgcgggaagcataccttgaccatcggcaggagcactggggctttcgtctcgggcgacaacttgtcatctggggtgcggccgacggcgtacgtatcaccgacctcgtctcacccatggatatgaccgagttcttggcgcaagactacgacgacatccgcatgcccgtcaatgccctgcggttcttcgtcttcaacgacaagataaagctcgaactgcttgccgttcccactttcgaaggatacaagctgcccaccgatgccgccaatccgtggagcgtgttgcctaaagaaacaccccggtcccttgtctgggacgcggagggaagccgccccgagctacgcctctccaacgtagaatacgggggcaggctctctttcgccctgccgggggtagacttctcgcttgccgcgctgcatacgtggaacaagatgcccgtcatcgagtacaaaccatcgggctcccaacttacggtttcgccccgatactaccgcatgggattcgtcggaggcgatgtctcaaagcccttgggacagttcgtgctgcgcggcgaagcggccttcaacctcgggaagcatttcagctacatacagcaagccgcctccacccctcaaaaaggattcaacaccatcaattggttggtgggggccgactggtatgcccctcatgaatggacagtgatggctcagttctcttccgagagtattttcaagtacgaaagctacgtcgcacagccccgccataattcgctccttacgctctgcgtgtcgaagaagttactggacagcaacttacagctttccgacttcacctatttcgacctcaaccacaagggctggttcagccgtttcacggctgactatgccctgaacgaccacatccacctcttggcaggctacgactggttcggaggaagcgagggtatgttcggcccgtataagcacaattcggaagtatgggcaaaggctaaatactgcttttgagatccacaccattttaataaccataaacaaaatttgaaaagattatgaagaagacatacgacagcagttaaagagaatgcggacttaagcaatcggaatcgtttaagttaaacggtgaaagacgttccaatggagcgatcaaagccgtttactgaagctgtttaagtagaacagcaaaattattcaaagtataaccatcaaaaacatcaaaagtcatgttactatacaacgtaaaaaaagaagagatgcgcatcggtaaacacaagggcaaaaccatgtattacgcctctcccattgcacaagacaagattaccaccaagcagctagaggatcggattgtcaatgccacagccctgagccgtgccgacgtgcggtcagccatcaccgccttggcgaaaatcgtacgtgaagagatgctcagcggcagaaccgttgacctggccaacctcgggtcatttaaggttgtatccaacgggaaacgcgtggaaacggaaaaagccgttaccgccgaaactctcaaaacaccacgcattcagttttttcccaaactcgaaatgcgcaatcaggcaaaaaacgtacagcatgtggtgatacgtgaaagcgaggccggatcggctaaaccgagtccgaatcccggagatttgcccgaagcacccgattctgctctttaatattcataacaagaaacaatgaagcagcaagtattatttttctttttcacgctgatgctcacaggtatcagcgtgtccgcccaaacaggtggaggacggattgcaggcgtggtcatcgacaatgcaggcgaagaaccactgcccggcgcaaccatcttcatcgaagagctgaaaaagggcattgtgacagacgggcatggcgagttcttactttccgatgttcccgcagccacttatacgcttactgtaaggtttataggctaccacacgcaaacccgcaagctcacggtgggtaaagagagagggaaaaaaatcatcatccgcctgaaagccgaagcaaaatcgttggacgaggtggtagtgatgggtaagagcgaagcccgtaagttacgggagcaggccatgcccatatccgttatcagcatgaaccagatacaaggaacggttaacaatgtacaagacattctggcaaaaactgccggaatcaccgtgcgtgccacgggtggaacgggcagtacctctcgcatatcggtgcgcggactggaaggcaaacgcatcgggcttttcattgacgggaatccgatgaacgacaattccgattttatcgacatcaatgatattccggtcgaaatgatcgaccgcatcgagatatacaaaggagttgtccctgccaagttcggaggttctgccgtaggtggtgcggtcaatattgtcatcaaagagtatccgcctaaatatttggacgtgaactattcttacggcagtttcaatacgcacaatgcatccgttgtgagcaagatgaacattgccccaaaaggaatcgagttcgggctgggaggtttttatacctatgccgacaacgactacaagatgaagtctccttttcaagaggggcttactataacccgcgatcacgacaagtttaaaaaaacagtcatcggcggtagctttaaggcacggaagtggtggtttgacttggtggagtttgaacccgttttcatacatacttacaaagatatacaggggatagaatcgaacatccggcatgcacacagccattccaacgcctttattttcgccaataagatggagaaagaaaacttcctcttagacggcctggacttggactggcagctggggtatatctataccgactatcattttgccgataccgcctcgcaccgcacacattgggatggaacgcattatccggcagtttccgaattcggcggcgaaatcggcaaatgggcttcattattgacgaatgaaaagcatcaattgcagcacaaattgaatctcaactatcttgtcaatgagaaccattcggtaaacttcaactctttgctgaaatacgctcatgccaaccctcgtgatgggatgaaggacaaggtcataggttatcgtaccgactttccaagcaatatgttcagttgggtggcaggcttgaattacgactatcgcacctcgaacgataagttccttaactctttcaacgtcaagtattactactactcgatgaaaacgcggatggcaagtgtcctggtaaagacagcagaggatatagacacacacaagaatgatttcggcatcagcaatgcacttcgctaccgcatcacacccagtctgatggcaaaagcttcgttcggatatgatgtaaggcttccatcggaagaggaactgttgggtgatggatacgtgatagctcctgccggcaatctcactcccgaacgcaatataagtgtcaacataggaatgttattcgatttaactggaaaagcctcctctaacttacagattgaactgaacggatactatatgcatctcaaagacatgattcgctttacgggcggattcttgcagtcgcagtatcagaacttcggcgagatgcggactcttggtatggaagcagaggtgaaagccgacatgacacggtggctctatggctatgtgaacgccacttaccaagatctgcgagatgtgcgtaagtatgaacaaaatacaactgttgccaaccctaccaaaggtagccgtatgcccaatataccctatctgatggcaaacgcaggattggagtttcacaaagaaaatctgttcggaggcagcgggatgaatacgcgcatattcaccgatgcttcatttgtggaagaatatctgtacgacttcgaacaaagccaattccagcagcatcgcatacctcgagccctctcgtgcaatataggctttgagcaaagctttggcaatgggcgctacttcattatgggaaaaataaacaacctgaccgatacaaaaatgatcagcgagtttaaccgtcctttacccggacgtagcttcactatcagattcagatacgtatttaagtaacaaattaacaatcattaaacaaaaaaagaaatgaaaaagaatgtattttttgtagcagcgatattcgctgcattgtgccttaactcatgtgacaagaatgatccggacaatcctattgcaggaggttcgggaaagattctcctaacaacagccctacccaatgcaacaggtatggatggaacggtttatatgcaactcattgatgagcctgtattaggcaagacgatggctaccaataacaacaatggtataaatgttccctttggcagttcttatcctatgataataggtcaggaagtctatgtcttcccaagctatcatttgacaatggacaaaaacgaactgattaaataccgtcgcacgaatggaattttacaaagagagggaagcttgcaattgcctgccaataacagtgccaacaatcttgtcaaactatcttccacaaaagcctatctatcgcttgccggactaggactgatttacatatttaatcccgaaacgatgcagaagacaggagagatcaacctgacctctttgggtattcaagataataatccggacatcggaatcatgattgagcgtgacggatatgtgtttgctggtctaagccagatggtgggaggttggacaagccctgagaattacaaacaagcagatgtagccgtcattgacaccaagacggacaagttggtcaagatgatttcagagaaaaccagtggtttttctcaagccacacgtccgatcgaccccaagtctttattcatggatgaaaaaggcgatatatacatttcttgtctcgggaacttcggaatggtggcaggtcataaggccggcatacttcggattaagaaaggagaaacagactttgatccaacataccattggacgataaccggagcttctatcgaaggagaagagaaagtagctggttttgccgcttcaatttgttatgcagccaatggcaaagcctacggatacattgatattcccggttattacaaaccaggagaaacgggacatggcgctatagcgagccgagctgtagtctttgatttatacaatcagaagatgaagaaaatagaaggattggatttgtccaatggctatggcgtgttagtgtctaaatataaagacggtttggcaatcgccaatgcttcaacgacaacaaaaggcatctattatctcaatcctcagacagataagattaatcctattcctatgataaccaccataggaaatcccatggctatagagtggttcggcaactaaacttataacgcgagttcgggatagcctccttccaaaaataaagagggtgtccgactgatgaagtgaccccaaaaatttggactggttaaacactatccagttatagaaagagttcggtattgtactggactctttccttttaaccgggacttaattcttttattattataataatctatatatccttccaaagcctttgtgaagtcttccggagactcgaacttttcagcgtatagaagttcagatttcataattctgaaaaaattctccatcatagagttgtccagacagtttccctttctcgacatactttgaattatatgatgctcttcaagccttttccgatatccgaagtgttggtattgctaaccttgatcagaatgaagtacgagtccgtcaaggttatcacacttatcaaatgctttatcgagcatgtcatatacttgttcaagatgaagtgcaccctcttacattttatttttttaggaatatccccaaataacttgatgtctgctttaacgatagaacctgttaggtgtttgcagcggacatcaccataacccattgccattaccactacttcttgcagttgttgtgagccctctcttaagttgatgaaaaacttccgctaattgtttaccggaacttcttgtgtttgataaccaatgaatgaaatgaccaaggtttcttcggaagatacattggctaatgcagtcggtgatacaaccgttgctggtaccttttacgaagactgacgcaccggtaaccagaccgaaatcatcattcacggtaccggaaatgcttagctagaaatagcttgtgagctgattctattttaaaatataaatgttagttttatgttagataattccggatactttaatcttaagaatttgattataatacatatataaatttatttgttagatttaaagtttttttttataactgtaaaatacagatttagccttatatttacaatatgatattattgattttatctagtaaaaaagcttttgcattataaggacattcaattcttcttccagaattgtagtatatgttttataatcataccaataagataaaaaagataatggtcaaaataaagctctcaaaacaaaatacttgttgttcaattatcttataatagtaaaaatgaatttgttgattccgcaaaagagtttgtatcagatgttgaggtttcaacaatattaaatattacttttatttatagtaactaatttgcattaatatgagaaaggtatttattcttttgtttatttctttagcattgttatcctgtcaaaaagaggaaaacaatagaaaaacagagtatcaagtattaacaagtaaggacgcatccaaaccgtttagctgtcttggagagaaacgtattattacgattacgattataaaaaaaacattaatagatgatgttttaagttcagaggttccgattattcccagggatgtttcggtagaatttgataaaactcttttttctgatatagaaacaaaagtggagggcgatcaggtagtattaaatataacctcaaatattaataaagaagataaaattttgaatgctgatttacagatttcttactctactattaatggcataaaagtagaaaaaattccactaattatagataaaggaaagttgacatttgtgtataaaatccattcggaacagaatccttttattctaccagctgaaggtggtagatttgagtcaccttttacttgtaaaaaacagacatatttgaatggccagtttatagaggaaacttattcatcattaaacggattgagatttaaaacgataagtagtggtaatgtctggttccttacagtcagaaaagacggagaaaaaattggtttttacaaattttcttttgtgggagaaggaccatataaccaaaaaacagatccagagtgctattttaacatatatacccatgatgcagatttaattacagataatcctacagaaatattcagacaagattttatacaaccccagaccccgggtgaggattattataaaccttcccggtcctcttataaacatggcacttttgacttttaacgtattcagtattaaccttaattatattaattataaaacagtatacacgtttgttgattttgacaattatgtttttaacttcatatttcgatgacagagaagtaatgaaacaagaatcttcgccaccatctttagtaaaaaaaactcggcttatcgtaactagtgtatattcactactttctatatactaatgcacttcttaatgtaggttatgtagtaattcattatttgaaagctgataaaatatttttttttgaatattttatcagctttgtatattgcataatatgatataaatgagatttatttttgctgcctcttggcacgcagcatttctgccgccttcatttccgtccaacgctcgaagtcctccacctctttccttattttccgtatcagtttcctgtccctgttccactcgaagcagttctccagtatgtcaagcaccttagcgtccattcccccgtcacagacagcttccccaacaaaacccgttaaatcattgtgttaatatatatttcatgtatctttgcggcatagatatctgttgtgaaacaggaatctgcttatattattcttgcttgtgacaagccggaatcttataacttagtacaaaataaaaaaataaaagaggagagcttccgttctatggagctcctctcactttttatctctagtgcccgactgccttttatctttctactttcccaaaaggagtatccttcccgccagcatacagcacagcgaaaacagtatagccactaaattcttctcatttgtgcaaccccttctgtattcatcttccaaccttgtatatcgctaccgagatagaaaatggacagatgcacagctggtacgtcaattatcaataccaatatataccagttcatacgttctccccaataaaaagatcccctaatttatttctagttcacagtccaaatttatactttcctgtaaaatacaggatatagtcaagtcttcaaagtttttcccctaaagacacagaaatattacaaaaatcaattatcacattatatcttatttctgatgatacaaaaggagatggcaatctattttttaattctttagatgacataaagaatgcctttaaaattaattattcagaatctaatttgggacttcctattttttgtaagggatattacaaaaaacaattccgtttttactttaactataagttctggtagggaccatccaaacatgttaccagaccaacaagaccaaggggaagagtttagaaggatgtattacagctactaaagatgataaatgccaaaaccaaattcattgcaattggaattggggtaacagttattttttatttttagttcaatcaagccgggaagaatgattaataataaaagaatcaagtctttaaaggaagatatcaataaataactcttgcaacatgcagtttctttctggctgaatttgcgactctggagctatattctgaggaacggtttggcggcggaatatgccgttaaaccgtccggttttcgttaaacgaaaacacaacttgctgtcccctctacggggacaacgtttttaagtagaactgtagattgccccgactggtgcctccctcccgatggcaacctctcccgatttcggtctgcttcttcaggaaagttggcgttttttaccaatattccggaggcggaataggctgtagcttcctgtaatagtagagcattctacgattatccgacacatcagatggcttctttttcgtgataattgaatattcagagaactgaatattttgataatcggataatccgaatactattatatctgtagtctcttggaatgttacacagtgacaactgaataattggcgttttggatattgctatatttgtataatggataagcaattataaaaggctacaattataataggctgttattatacattccccatcagagagaaagttccttgagcctgctgccgtccagccggtgaacggataccgtaccgtcacagtaaatagcgaatgttggcatgttcccgtccttcgggaaagtgatggagccggtattgcagaccgctgtatgctcagtccgttcaagtttccaccggtgggtgtgaccataaaaaagacaatcgaaccttcccttcggcagtctgtcctcattgtagatatgtccgtgggtgagaaagaaacgttttccattatccaccaacagggtgtaatcggacaggatgggaaagtccagcagcatctggtccacctccgaatcacagtttccacggatggcgacaatctcaccggccatcgcattgagacgttctgcgatccctttcgggtcaagtccttgaggtatcccgttccggggaccataattcaggatatctcccaaaatacaaagcattccgcattgctgctccctgtaaaatgccagcacttgttccagtgccggtaacgagccatgtatgtcggacacaatcaggtatttcatcataatctattcgttacgggttaagttttcaatgcacaaaaataagcataattatctaatctccctaaccggggaaacgatgagaaaaaaagacaggttccctgaactgtagattgctgtattgctgtccttgtagattgctgcaatgttataatcggatacataaaataagggtatttagccttagctaaactaagctaacagtctgacaataaggcttctaatactatgacatgtgggtttattatgctaccttagtggtataataataaaggataaaaagctatgaacgaacaagttagaaatatcttagaacagagtaccaccaagacgagcaagattgagcagctgctccgtctgggcctgatgcgcagggaaattgccgatttggtgacacgtggcaactatggttttgtatataatgttgagaagaaaatgcttgaaagagaaggtggagtcttgctgaacagggcagcaaccaccctgatggattacaccttcacccacaagttcggtattgagattgaagcctataactgtaatatggaaagactggcacgcgaattgagggaggccggtatccatgttgccgttgagggttataaccacacgaccaaggatcattggaagctggtgacggacagcagcctgcagggaaataatactttcgagctggtcagcccgatactggtgggtgagaatggcctgaaagagctggaaacggtatgctgggtgcttgacatctgtaatgcaaaagtgaatgacagttgcgggttccatgtccatatggatgcggctggtttcaatctggacacctggaagaatctgactttgacctacaagcatctcgaacacctgattgatgcctttatgccaaggacacgccggaacaatacctactgcaaaaccctctccggtgtttccgacgagagaatcaaatcggtaaggacgatagacggcctgcgggaggtctttaataatgaccgataccacaaggtcaattttgaggcttattctaggcaccggaccgttgagttccgccagcattccggtacgaccaatttcacaaagatggagaattggatccggttcttgaacggattaattacctttgcgaaaagatccagccttcccagccggatgacattggaggagttacccttcctggacgggaaacagaaattattttttaaacttagaactaaaaagttagcggtatgatacagacttatcatttgctggatggcggtcagataaccgccgccagcccggaagagttcgtccggctgctccgtgaggggagccggttcgactatgattgcacggatcaggagtatatggagaactttgcccggcgttacggggagctgcatggcgtgtcagttgccaccgatacccctgaacatttcctgacggacttgcaagccgccggttacgtccggtaaccggtatcgctcctttattattagtccctgcttcaaagatgaggcagggatttttcttttttcattgcaacctttcctgtctgcctgacggcgtttcctcctgtcaattcctgactatccatgactatccgtgacagggtatttcatcttttcccggcattcctttcttttgcagtgtagaacgatatacaattataagcattacagttttacagcattatatttttatctgattatataaagaaagcgtatgaaaaaagaaccgttattaattgcctttgccagccagaaaggaggagtcggaaagtctgccttcacagttctggtggccagtatccttcactaccagaaaggtttgaaggtgggtgtcgtggattgcgactccccccagcacagcatctcccggatgcgtgaccgggacatagaaagcgtgcaggaaagtgattttctcaaagtggtcctctaccggcagcatgaacaaatccggaaacgttcctatccggtaatcaaaagcaatccggagaaagcgatagaagacctgtaccgctacatcgaagagcaggatgccgtctttgatgtcgtactgttcgaccttccgggaaccctccgcagcgaaggggttgtccataccatttccgcaatagattacattttcatccccctaaaggccgataatgtcgtcatgcagagttccctccagtttgccgaggtggtggaggaagaactgattgccaggcacaactgtaacctgaaaggcatctatcttttctggaacatggtcgacaagcgtgaacggacagaaagctacgagtcctggaaccgtgtcatacaaaaagcggagttacacctgctggagtcacggataccggataccaaacgctataacaaggagttgagctccctgaagaacagtatcttccgttccacactgttccctcccgacaaccgccagataaaaggttcgggtctctgtgaactgatagaggagttatgtgccgtaacacatctggatgcctcccataccttataataaaaggaattatggacagcggaaaaaagaaatttgaccctcggagcattgatgagaaggccatattggatattgtcgccaggaaagggacgatacgaccggactcccctgcaacgagtgtatcccctaagccggaggatacggcagaggagattgccgggagtagcgaagctccggtctttaccaccggggaaatcgacgcttacagggcatccttcctgaatacggtcaggaccaaatcccgtaaatcattgcatatcgatgccgacctgcatcgccgcatctcttccttggtatgggcggtgggacgtggcgaggtgaccgtagccggttttgtaaaccaggtgctggcacatcatttcgaagagaacggcggattgataaacgctgtgctggagaagtattaccaatcactaaaatcataaggacatggaatacctttttattatcctgttcatctatgcctcttacctgagcattgaaaagtatgtgcatacaggcagcattttcacatggagaggcagaaaggacaagaaggaacgtcggactgcacctgccgccatccatccggcaattgctccgtctcaggcgggaataataggcaaaagccgataccaaatgcgacattcactgacaatagatgacaatagcggacagcctgaatcaggcatagaaaagagtgatacctttactcccgaaaagaaaacagagccggttctccgagtacacgaaccccttgataagaatacgaaattcccggaagttccggctctttttcaaaaactgaattatcctgaaattgattatatgcaggagccctctccttcttccggtgaagaaaaagaggagattcccgaacgctacgagattacgggatacgtacagcggagcaatccccaccgggcaaccggtgtcacctttgacgatatggatatgattgagaaagcaatggcatcggacgaacttacggaagcggaacaggaacaggcccggcagactttccaaaagctggaaggcacgaacatggaaagggtactgcaggcgagcgtcttgggaagcagcgataaactgaaacgctatatgcgtttgtatgtagaccggggtgaaccccatttattgactggaaagaatagggacgacattctccgggaatttgatattacggagcatgtgccccaataaaatagaacaagtaaggaatatgagacagtattatgattccggttgatccgggtgcagcgagttttaaaacagaatgtataacctaaaaagacgaaaaagcatgatagatttctttgactccggttgatccgggcaggacgggttcttgaaacgtagtgtataacctgttaaaaggaagatatagatatatgagaggcttctatgattccggttgatccttaccctttaccggagcgaacattaaaagagtgattaaccccttaaaaacggaggtatctatgattggttactatgactcaggttgatcctaaaaagacatcgtggttgcaaggacaaatccgcaggcaggaaacttcctgcggtttgtttgaaacaaggtttttattcacattaaaaaattagattgtatatgaaaagacattttaaaaagacggttgctcttatcgcatgaatagctgtttccaccctgagtgcctatgccgaaggggacggaagtgccggtataacaaaggccacatccatgcttaccggttattttgaccccgccaccaagttgatatatgcggcaggggctattgtggggctgataggtgccattaaggtatattcgaagttcagtagcggcgaccccgacaccggtaaaaccgccgggagctggtttggagcctgcgtcttcctcatcgtcgcggcgacagtccttcgttccttcttcctgtaatatagcaggctatggaatacaatatcaacaagggaatcggacgcaacgtggaattcaacggcttgcaggcacaatacctgtacttttttgtcgggggcttgctggccattttcctgctgttcgtcatcttctatatgataggtattgaccggtggttctgtatcggtttcggtgtcctctccgctttctctctgatcttcggggtgttccacctgaacaagaagtatggtcccaacggcttgatgaagctggccgcagtcaagtaccacccgtcctatatcatcaatcgcaaacgtatatcttccttatttaaaaaacgcattcatgagaaatatattaaaagccgcaacgctggaaagtaagtttccaatcctgtccgtggaggaagggtgcattctctccaaagacgcggacgtgaccatcggcttcaaggtctttcttccggagctgttcacggtcacttccgcagattatgcatccatgcacggcacatgaacaaaggcagtcaaggtactgccgaattatacgatagtacaccgccaggactggtttctgaaagaaaattacaaggccgacacgcagaaagacgggatgagttttttggaccgttctttcgaacttcattttaatgaacggcctttcctaaatcatttctcttacctgtttatcaccaagacgactaaggaacgcagccgcagccagagcaatttctccatcctctgccgggggaatataattccgaaggaagtccgggacaaagaaacggtcagcctgtttttggagagtgtcgaccagttcgagcgcatcctgaatgactcggcctttatccgtctggagcggttgaccaccgatgagatagtcggcacaccgcagcaggccggattgattgaaaagtatttttctctttcgcagcaggacacgaccacactgaaggatatacagatgagcgcgtcggagatgcgcatcggggatgatatcctctgcgtacatacgctttccgatgtggatgatcttcccggttccgtccagacggatacccggtatgagaaatactccaccgaccgcagcgactgccgtctaagttttgccgctccggtggggctaatgctctcctgtaaccatatttacaaccagttcctgttcatcgatgattcggcagaaatcctgcaacgctttgagaagacggcacgcaacatgcactcgctttccaaatacagccgagccaaccaacttaacaagcagtggattgatgcctacctggacgaggcgcattccttcgggctgaccgccatccgttgccattgcaatgtcatggcatggtcggacagccgggagaagctcaaggtgataaagaacgataccggttctgctctggccctgatgggatgcaagccccgttataataccattgacgcacctgccttgtattgggcaggtattccgggaggcgagggcgatttcccttccgaggagtcctttttcactttcgtcgaacagggagtctgcttctttacggaagagacgaactatgcggattccctgtcgccattcggtatcaagatggcagaccggacaaacgggaagcccctgcatctggatatttcggacgaaccgatgcgtcgtggtattacaaccaaccgtaacaagctggtcatcgggccttccggttcgggcaagtcattttttatgaaccatcttgtgagacagtattgggaacagaatacccacattatattgatcgacatcggtaacagttacaagggattatgtgacctgattcaccagcgcacaaacggtgaggatggcatatattatacgtatagtgaaaaacatccgatagcttttaatccatttttcaccgaagacaaggtctttgacctggaaaagaaagagtccattaaaacgctgatcatgtcgctctggaaaagggatacggaagtcattacccgtgccgaggaagtagcactctcaatggcggttaacctgttccttgaaaagataaaggaggacaatgagctggttccttcctttaatactttctacgagttcgtacagggagagttccgtggaatactggaggagaagcattaccgcgagaaggatttcgatctcactaactttctgaatgtattggctccttattatcgtggtggagagtacgattatctgctgaactccgacgagcagctcgacctcttgaacaagcgttttgtggtatttgaaattgacgaaattaaggagcataaaattctttttccggtagtcactgtcatcattatggaggctttcataaacaaaatgagacgtttgcatggggtgcgaaagatgatagttgtagaggaggcttggaaggcaatcgcacgtgaaggcatggctgactatataaagtttttatgtgcgcccgtaaaggttgcatcgtaaatatctctttggcaagagattaggaaagtgttctttgaaaatgacctatcatcagccgacttatctgtttcgggaaaacttaaccgagcagggagtgtagcatgtcggaaaagtcataagtcagttagttaccaaactgcgactgaatggcgagatgaaaagatagatatgaggataaagtccgaattgattgaacgatagtccgaatggtcccccttgaggctatggcgtaaggtaactatcaatcgccatatcgtgatactacttcagtgtataggaatgaaggtagcaagaacttatcacgacacaaccgcagtaagcgagtaaaggacggaagtcgtatccgacaatctatcatgccaacagttacgatgtaataaacggggattacctatcccgaagtgccgaaaggctattaggttcgacctatgaaaattcggagtggtaacggagcttccatagtagtttgagcaaggtaacgccttgtacatggcgaagggaagcagctaattattaatacaattaacggaaaatgtgagagacattatgagaagtccagaaagagtattaaacagtctatcagaacacagtaaggatgcaagctataagtttgaacgtctttacagaattttgttcaatgaggaaatgttctacgttgcctatcagcgtatctacgctaaagagggtaacatgactaaaggttcagacggtcagaccattgacaacatgagcctgaaacgaattgaaaagttgattgatacgttaaaagatgaaacgtaccagccccaaccgtcaaagagggtgtacataccgaagaaaaacggtaagaaaagacctcttggcgtgccgactttcaatgacaagttgatacaagaagtagtaagaatggtactggaagccatatacgagggaaattttgaatacacctcgcatggtttccgtcccaatcgaagctgccatactgcattaactcatatccaaaaggagtttaatggtgcaaaatggtttgtggagggagacataaaaggcttctttgataatataaaccatgatgtattgataaacattctcttggagcgtattgcggatgaacgcttcatccgattgatacgcaagtttatgaaagcgggatatatcgaagactggcaattccacaatacttacagtggcacaccgcaagggggtatcatcagcccgatattggctaatatataccttgacaagctggataagtatataaaggaatacacagccaaattcgacaaagggaagaaacgaaaattcagtagagaaagtatggactttggcaatgcaagaaaacgtattgtgcgaagattgaagttcgtaaaagacgaaaggcaaaggacaaagctaatccttgaactgaaagcaatagaacaaggacgggctaaatatcccaacggcgaagaaatggatgccgattacagaagaatgaaatatgcaagatatgcagatgattttcttgtgggaattatcggaagcaagcaggatgcgcaacagataaaagaagatattaaaaacttccttgctgacagactggcattggagctgtccgatgaaaagacacttgtcactcacacggaaagaccggccaagtttctcggatatgaaatcactgtaagaaagtccaatgaccaaagacgggataaacggggtagattgagaagaacctatggtaaaagggtctgcttgaatgtcagtacggaaacagtccgtaaaaaacttttcgattggggagtattggaactgacaaaccgtaacggaaaggaaatatggaaaccgaaatgtaaatcgggactgatattcaatgacgaccttgaaatccttgatagttataatcgggaaatcgtggggttctataattactactccatagccaacaactgcgcccatgccttgaataatttcaagtacatcatggaatacagcatgtacaaaacgtttgcaggcaaatataagtgccgaacacgtaaggtaaacaagaaatatcgtaagaacggtaggtttatcgtaacgcacatgactaaaactggtgtaaaggaaagatacttttacgacggtggcttcaaacgaaagaagcccacctataaatcggaatgtgacattatgccacgaacaatttatactgcggggcggacaagccttgttgaaaggctgaaagcccgtgagtgtgaattatgtggagcgacagacgaccttgttatgcaccatgtaaggaaactaaagaacttgcagggaaaggaaagctgggaacgacacatgattgcccgtaaacgcaagacgattgccgtgtgcaggagttgtcacaagaagatacatgacggaaagatagactgaaattagtggagagccggatacgctgagaggtgtaagtccggttcgggggcgagcatttggaaacctaccatagaaatatgataaggcgctgggtgcttagcctacacaaaacggttagaaagtattttggtgaggccgttgtcgtcactcaagaactggacgatattgtatcaagtcccattatcaaagacaccattatcaacaatgccgattgtaagattctgctggatcagcgaaagtatattaacaagtttgactccgtacagtccctgctcggattgaccgacaaagagaaagggcagatattgtctatcaatcagtccaacgatccggcacggaagtataaggaggtttgaataggcttgggaggtgtccggtccgctgtctatgccacagaaacctctgtcgaggagtatctcacctataccacggaagaaaccgaaaaactggaagtcacacaaatgacagagaagctgggcggcaatatggagcaggctatccgaatgttggcaagtgagaagaaaaagaaaaaataaacgattaaaataaagaagcaatgagaaagagaattataagcatgttgtttgtcctgtcggcctttatagtaccggcaagcgtacaggcacagtgggtggtgtccgatccgggcaacctcgtccagggtatcgtgaacagtgtcaacgaaatagtggagacctcggaaacggcgcagaatgccctctccacatggaaggagacctcaaagattttcgagcaggggcgtgagtattacgacaagctgcgcaaagtgaacgacctgatcagcggtagcgagaaagtcaaggagtccgtcctgatgctcggtgatatctccgagatttacgtgaacaatttcggcaagatgctaaccgacaagaatttcagccagcgggagctgaatgcgatagctgccggttataacaccatcatgaagaagagcagccgcagcattaccgagctgaagaatatcatcaatcccaccggcatgtccatgaacgacaaggaacgcattgacctggtgaaccgggtatacagggaaatgacacattacaaggaattggccaactactacacccgcaagaacctgcatgtatcctacctgcgtgccaaggagaagaacgagcagcaacaggtatttgacctgtacggcaaggatgagcgttattggtagtctacaattttaaaagaatcaattatggtattattatccatttcatttgaaaatatgcaccagattcttcggaatctctatgatacgatgaccaaactctgccacccgatgatggacatggcgatggcactcgctgcattaggagctttgttctatatcgcttaccgtgtctggcagtcgctctcccgtgcggagcccatcgatgtcttttcgatgttacggccttttgtcctgggcatgtgtatccttttctttgacgtgatggtgctgggaactctcaacggtatctttagccccatcgttcagggaaccggaatgctgctccgtgaccagaccttcgacttgcagaagtaccagcaggagaaggacaagctccgtgcggacatgatggctaagacgatgatgaccggacgtgtctttgcttccaatgaggagctggatgcggaactggataacatgggctggagtgaggaggagcatacggccttgcagaccatgtatgaggtttcgtatgccttctccctgcaaggtattgtccagatggtcatgcgcaaattgctggagattctcttccagtccgcttcgctggtcatcgacacgatccgtacctttttcctgatagtcctaagcattttgggaccgatagcctttgccctgagtgtttttgacggactgcagaacacgcttgtccaatggctggcacgctatatcagtgtctatctctggctaccggtggctgatctcttcggggcgatgcttgccaagatacagacgctaatcctgcaggaagagatgaacctgatggccgatccgatgagtgtcattgacgtggacggttcctcggccatctatctgatattcatggtcatcggcattatcggatatttttgtgtgcccactgtttcgaactggattgtccaagcgggaggtatgagtgcctataaccggaatgtcaacaatacgacatccaaggtgaccaatgtagccggtgctgcggcgggtgcttcgacgggaaatgtcggtgccgtattattgaaaaagtagaaattgaaaaaacataaaattatggaatttaaaagttttaaaaacatcgaatcctcgttcaggcagatccgcctgttcacgttggtctttctgggtatttgtgcctcactgactacgtatgccatctgaaagtcctacctctttgctaaccagcaacgggagaaagtatatgtattggatcagggcaagtcactcatagtggcgttatcccaagatgcggcattgaaccgtccggtggaggcccgcgagcatgtgcgccgcatgcatgaactgttctttacgctggctcccgataaggccgctatcgaatccaatatcaaccgggccatgtatctggcggacaagagtctttatagttattaccgggattggaacgagaaaggctattataatcgtctgatcagcggtaatattaaccagactgtcctggtagacagcatgcagtgtgatttcgataactatccgtaccggatcaccacctttgcccggcagatgattatccgaaacagcaatatcaccgagcgttccctggtcacccgttgcttcctgcagagtacggtcaggtcggataataatccgcaaggcttcatggcggaacgctttgagattttggaaaacagggatataaggaccgttgaacgctaatatattaaggtaatgaaaagcaggaagataaagacagagatcagcgaaaaactgaagaacgtttgcgaggagctgtccgaaaaagagcgtaagggagtgcttgtgggcatgctggttaccagtaccgttctatgtggtatcaccgtagcacgcgctttcgggcgttttctctctcacggcacacaaaaggagttgccgtttgtccatccggtggactccctccaccgggcggataaagacagtataatgtatcaccctaaaaccaacgagtaatggaagataaagatttggaaaagcccgaagcggcagaagaaacggcggtacagccggaaaacggcagagccttgaaggaagaacctgaaaaagagaagaaggtgctcacaccggaagagatggaaaaaagaaggaagttcattgtgattccggcctttgtgctggtcttcctgggagtcatgtactgaatatttgccccctccggcaaggaaaacgagacggaagcccccggaaattcaggattcaatgtgaacgtacccgaacctaccactgccaaactggtggataagaagaccgctgcctatgagaagcaacaggcggaagtggaggaagaaagccggatgaagtcgttggagcagcttgccgggacattaatgaacgaaggaaagggggcatccgataccggtgaaaaagaaaaggacggagaccggttgcaacagtccgttaatacctacgagcaaatctccgggcagttgaatgacttctatgagactcccaaagagacggcaaacagcgatttggaaagaaaagtagatgaactgaacaaaaagctggaagaggcggaaaaggagaagaacaaggcggctacccgagaagaactgatggagcggtcctacaagatggcggcaaagtatctgaacccggataaggatacggtccaggagaaagctgtcggaaaagaacccacggaaactgttccggttcagcgggcggagtatcagacgacctccggcctttcacaacctgttacggattccgcctatatcgcttcgcttactgtcgagaggaattacggttttaatactgctgtcgggaacagctaccaaatggggacgaataccatcgccgcctgcatttcggagaaccagatcattgaacagggaggcagggtaaaactccggttgctgcaacctctacaagccggcaacattaccgttccggagaacagtctggtaacaggtgcggcggtcatacagggagagcgtctggatatcctgatcagcagcatcgagtatgccgggaatatcattcctgttcagttggcgacttacgatatagacgggcagaaaggtattttcgttcccggatcggaaacccgcaatgcggcaaaggatgcggctggaacggtcagcgagagcatgggaaacagcgtttcgtttgcacgttctgccggacagcaggtggtcatggacctgacgcgcggagtcatgcagggcggcacgcggttgatcgccggacgggttcgcgcggtcaaggtgacactgaaagccggatataaggtgctgctggtcacaaagagacaataacggattattcactttaataaaaaagacaagacaatgaaaatagttatagcattcttgatggctgttctggcctcggtatccggtttttcacaggaggaaaggccggtaaatcccgtcaggattctgacggcgggccagcatatcatcccttataaaatagaggtcacttttgggaagacggtgcatatcctcttcccttcggaagtgcgctacgtggatttgggcagtaacaatatcatcgcaggcaaggctgacggagtcgagaacgtggtacgtgtcaaagcggcggtgaaggagtttccgggagagacgaacttctccgtgattacaggagacggctctttcttttccttcaatgtcgtttataaggaagagccttccacactgaatatcaatatggaccagtggatgaacccggacgagggagaaaagaaaggaggcagctccatccgtgtcacggaactgggcgaggaagatccgacggtcattgccagcgtgatgtacaccatccaccggctggaccgtagggacgtgaagcatatcggatgcaggcagttcgggatgcaggctcttttaaagggcatttatgtgcataaggacctgatcttcttccatgtttccctgacgaacaattccaatgtgcctttcgatgtggatttcgtgcgatttaagatagtggataagaagatagccaaaaggacggctcagcaggaaacttatattgaaccggtacgcacgctcaatgccctgacacgcatcgaaggaaagagcacgggacggatcgtgtatgcctttccgaaaattgtcattcctgacgacaagttgctggaagtggaaatttacgagaaagggggaggccgtcaccagcggttctatattgagaacagtgacctggtggacgcgcgtattgtgaatgaattaatcggtgagtaatcatgaaaagagttttatttattttgttatgcatttgtctgccctttgtggcaggcaaatcttttgcccagcgttacctgccggggcagaaaggtatccagcttacgttaggcggtgtagacgacttcggttcaaatgtgaagcatctgcatggtaatttccaggtcggactggctctgagtcggtataaccggaaccattcccgctggctgttcggggcggattatgtgaaaaagcactattcctataaggatgttgcgatccccaaagcgcagtttaccggggaggtaggttatttcgtgccgttcatctcggaccgtggtaagaacgtgttcttctctgccggtctttccgctctggcgggttatgagacgaccaactggaactgcaagctgctctatgacggggcgactttaaagaatgacggatgcttcatttatggttttgccccggctttcgagatggaggcgttcctttccgacaggctggtttttcttttcaatgtccgccagaggatattcttcggatcatccgtggggaatttccacacggtggcagctgtcggtgtcaagtacattttcaattagcagcaacagtatggaacaaggcaattggaacgtggatgagatgcttcattggctggatatgaaaataaaccgggaagaccggaacatacgtgaacaaagcaagaagatgaatgagaatttcctacactttttcgaatggaatgcggagagcctgtataagtctcattttatgtccgggtgttataagatactccggcaggcggtggacggggcaaagggcatggatacggtttggaatattgttgaggacaacattgcttactgtgagaacaaactgttgaacggtcaggtggattgtaacagttccagccggacaacgaatgttgcccatttcctgaagttggagtgtatgcagcagttagttagggattaccgggaattcgcgaatatccttgcgcaaacgcctcccgaagagaatttgcaacagacggctaataaaacagaaaagaagagagaagagccgcctgaaagaaagataaaaacgggcatcaggcgttagccgacaacggactcaatcaagtaaattattcatttagtaatacgtaaaatcatgaagatgaaattaataataagtggtatcatgctcacattgctttgcctgctgggtggctgtgatgataaattggaagtacagcaggcttatgatttctcgctaacgtcctggtatctccagaagaccatttccccggatgagaccgtggagattcgtctgacactcaatcgtagcggaaactatgaggaagccggctatcaaatcggttatatacagatggagggtagcggcgaggtgtacgacaagaagaaggtctatctggtgaaccgggagatgcaaccgttggattcgatagcggagttggatgacagcgatccctgccgccaggtattcacgctcttctatcataaccgaagcagcaagaatgcggaaattaaattcgtgatagcggataatttccatcaggaaagagaactggatatatcctttcagagcgaaactgaaacggacatggaactataaatcggacaacaatggataaaagtgatttaaggatcgaacaattgcagcaatatcttgacaagaagaaaggggttgtggaaagcgatataaaagagtataaccagcaactgggaaaaaactatcttcatttctttgactggcatgccgatgacttgtataaggcctgttatatggataagaattataaggccattcaggaggcgattgataccgctgaaacgccgaaggacattgaaggctatttgaagcgttgtaccctgtatatagaagaagatctcctgaacggtccgcttgtcaagaaaagtaccaacccgatgtcgaatatggcccattccctggagatggaatgcaaacaggagttactgaaggacctccggtatttaaacaggcttcttcagagtgagactgtaagtgaaagaataaggccgcaagaagcaccccgacaagaaattgtgcctgtgaaagaaaagaagaaaacgggaccacggttgagatagtatcaattgaaagcaataaaaaagctactgaatttttgtttcagtagcttttttatttatcccggtcttatattccggctataccagataagcctcaaaaagataatgtatgaataaccggcccttttccgtccagaccgtcaacatggccgtgcctgtttctcctgtgcggctttcccatacatgggtccgggttgctgtatagccttgattctggtaaggagctttgagcagccactgaccggattgacggaactggatgcctgcccatcggagccgcttgttcaacattccggcagtcattcccaattctttcgctatctgtgtggtcgtgtaggtgctttgggattgcaggactttgtcgtaatactgaacttttggggcctgtagcttgagtttcaggatagcatagttgttctccttctccaatgctgaaatacggctgtctcgctcttttatacggttctgtgcgagcaatatggcacgcgcaagcagttcattatccgtttcgccattcttcttaagaagatagccaccgttctttagtgtttcgggaaccagttcatcaaatatccagctttcgaatttctcagcggaaggcagcttgctaccggcaatcagccggtatacgtttccttcgctgatgtacttgattttctggacggcactgcgtgtaggggtgtcgtaaaccacgacacccattggtttacaatgtcttacgacggcatctctcggattggagtagccaagtgcggcggcaacatccgaggcgcagaaccatattttcccgtcaatttccagtgtccggatgcgtccgaactcgggatgttcaaatatcgatactttattcatgactgtttaatttataggtttcttctattgctttaaatatctcgtagactacctgggggacgatagcgttcccgtatcctttaatggatgcctgtcttcaccgagaaaaggagataccgtccaatcgggtggaaagcccatcatctcggctacaaacaggggattgagttggaaactctttccagtccgggcgaagaaatccggaaggctgttcttctgtggtatctttccccgtttcttcaggttctccagtgaaggtgcgcctttccaatcccgcgctgtcggtgtcggcatcacttgtccttctgccagccattgtaggatcgattcttccagattgttcccgtccgtgttttccagctcagtattgtccggtatcggttccggtagtatcccgtaaaagtccagaaaatccgtcaggccgttgggattcttctctccggctatctgggcatggggtgaggataaattcatcgatttccatttcctgactctttcggcatggtgtatctctgttgccactggcgttggcagaagcattccatggattatctccggtagtccctgctgcctgctgcccggccccctgcgcttgtagtcctgtgccgtcacggtgggcaataaaccaaactctatcccgtctgtgaggtgcaccgacggaacaagccggtataagtaccggctggacggaatatccttcgcgttcaagatcacggcaaatggtttcaacaacatattgctgtcgtcttttaaatacaggctcactctctccgaatagagtggattgacttcccacttcagtctcctgaccgggctgtaccatcgtgaggatgccagcaacgttctcaccaatgacccaatcgggcctgatctcatgtatggccctgagcatgtgaggccagagatagcggttatcatccgctccctttctttggcctgcgacggagaatggttgacaaggaaaacctcctgtaaggacattgatttttcctctccattccctgaaatctgtcgttgtgacatctgtataacttttcgcatctttaaaccagtaatttagaatggtattacaaaaatcgtctatctcgcaatggaaggcattctgccatcccattcattcggcagccaggtctggggcgccgaatccactaaacagggaagcgtgtaccagacgcttccgctgtttcttgtcttgctcttcttctttcattgtttattcattatttagaggttcgaggttcattacttttttgtcgatcttacgatagatgctccccatctccagcatattttccaatcggagcaggtccgtgatttcatagacggtcatccctttctgtgtcgtgaagcggatatatcctttctgtcgctgtatctccacttcttcgggagtcatgtgcaggacttcacagatttcctgcaaggtcagggtaaggcttacttccttaactgtgtagatgtaagtcaggatgttcagcatctggaggcatttgcggtgtgatttgacgagtgctgcgaatttgtttcgttctatgacgattactttactttgattttccatgtgaatttttatttatgagttaatagaatcggatatgaaatcttcgtttagacattcttctctcaggaatttatatacgtcagaagcccagaagtaaatcttgccgctgagtttgaaaaatgggagtttcccggaattacgccagcggatcagtgtccggtcgcatactttcagcatcaggcgcatatcccggctgtccagcatttgcttaccgttgaaactggttactgcttccagagccgtttccagcttggcaatcagttttcgttgttcctcaaagttgtcctttatcattgctttgagtatctcaatatcatttctgttctcttccatacaatattcctttgttctaatgggttatttttctttcttcggttgcaaagttttcaaaattaggcatgaaaaaatagggctgacggtaaccgccagccccacattttccttgtaactcacttggtatcaatgtgaattttcagaatattttttcttcatcaggatagaaaggggaatacacgcaattctccttcttaaaaaagagactgatagaatgacagaggatatcggataaaaaaagggctgacaattaattgtcaacccttctataaatatgctatgattaacttggaagcatcaaaaacattgcttacctttgtgttacagagatatttgaaattatgcagagcaatgcaatgtgtagctgaacttccactactatatcgttacctgcatctttataaaaacacttttaatcgctgatttataaaagattaaaacgaactacactcttttacaccgggaaacaaagtgtttcacaccgagaaaccaacagtttcatgccgggaaacaaaaagtgtcaagtgtcgaaacaaaaagtgccctacaacgagagcaaaggtttcaaatatcgggaccgggagaacaaagtactgaaacagccttatcaaaaggattaacaaaggaatattccttggattaccgggcgatatatgcttgtaaacaaccaaaaacgatgggtaaaaaaagttatatattctgttatccttagagttatttgttaactttgcagccctactacaaacgttatgatacaacgatataacaaaatacttatactgttcttactcgtattggtagcttccaatgcttttgcgcagcaaattaaaggggtagtcactgattcggttacccacgagccattgatgtatatctctgtttactaccaagaaaagagagatatgggtactatcaccaatattgacggagaatacagtcttgaagcccgcagaaacggagggacactggtgttctccgctgtaggttatatcagtaaaacggttcgagtcggttccaacaatcagacagtgaacgttaagttagctccggataatgtgctcctgaacgaggttgtcgtgaaacctcaaaaggagaaatattcccgcaagaacaatccggcagtggaattcatgaagaaggtaatcgaacacaaaaaagcgcaagtactcgaagtgaacgagtactatcagtacgacaagtacgagaagatgaaaatgtccatcaacgacctcacaccggaaaagctcgaaaaaggtatctacaagaaatattcattcttaagagatcaggtggaagtgtcggaaacaaccaataagttgattctccctatttccgtacaggaaacgtcctcgcaaaccatctaccgcaaaaatcccgaaaacaagaaaacgattatcaaaggaaagaattccaatggtatagaagaatttttctctacgggagatatgctcggcactgtattgaaagacgtatttgccgacatcaatatctacgacgacgatatccgattgctccagcagcgtttcgtcagtccgatcggtaacaatgccatctcattttataaatattatctgatggacacattgatggtaaacaagcgcgaatgtgttcacctcacttttgttccgcaaaactcgcaggacttcggattcaccggacatctgtatgtattgaacgattctacttatgccgttcagaaatgtacgatgaacctgcctaaaaagaccggagtaaacttcgtcaaccgtatggacatcgtgcaacaatacgagcaactccctaacggaaactgggtattggcggatgatgacatgaccgtagacctgtcctggaattccaacaaaacagcaggcggattgcaggtggaacgaactacgaaatatagtaattataaattcgatcctatcgaacaacgactgttccgattgaaaggcagcgtgataaaagaagcggatatgctttcgaaaagcgatgagtattgggcaagtgttcgtcaagtaccgctgacgaagaaagaaagttcgatggatgtattcgtcaaccgcctcgaacagataccgggattcaaatacatcatcttcggagcgaaagcgctgattgaaaactttgtggaaacaggaagcaaaggtcatccgagcaaagtggatatcggtcctatcaacaccatgatttcgagcaactacattgatggtacccgtttccggttaagcggcatgacaacagctcatttccacaaacactggttcttgaacggatacggagcttacggtctgaaagacaaacgctggaaatatagcggtacggtaacttattcgttcaataaacgcgattatgttgtctgggaattcccgaaacattatctttcggctacgtacagttatgatgttatgtctccgatggataagttcctgttcactgataaagacaatatcttcctgtcagtaaaaacaacgacagtagaccagatgtcgtatatgcgcgatgccaccattaattatgaacttgaaacgctgacaggattcggagtgaaagccatgctgcgccatcgtaacgacgagcctaccggcaaactggaatatctgcgcaatgatgccgcgcaaacccgtgtgcatgatgtcacgacttcggaagcgagcctgacgctgcgttatgctccgggcgaatcatttgtcaactccaaacaacgccgcgtacctgtatcgctggatgctcctatctttaccctgactcatgccatgggtttcaaaggagtactaggtggagattatagttttaaccgtacggaagcaagtgtatggaaacgtttctggcttcccgcttcctggggaaagattgattgtagcttaaaagcaggtgctgaatggaacacggttcctttcccgttgttgatcttgccggaagctaacttgtcctacatcacccagcgcgaaacgttcaacttgattaataatatggaattcctgaacgaccgttacgcttccatgtcattatcttatgatatgaatggaaaactattcaaccgtattcctcttatcaagaacttgaaatggagagaaatgttccgcgtacgtgctttgtggggaacattgacggataagaataatccgtttaagagcaacaatcccgatttgttccgtttcccgacacgcgacggtaagttcaccagtttcgtgatggacccgaaagtgccttatattgaaggaagtgtaggtatctacaacattttcaagttgctgcacgttgaatatgtacatcgtttcacttatcgtgataatccgggtatcaacaaaaacggtattcgtttcatggtattaatggtattctagaaaattatgcaacctttagcagaacggttacggccaaaaactttggatgaatatatcggtcagaaacatttagttggaccgggagccatcttgcggaaaatgattgacgcaggacgcatctcttcttttattctctggggacctcccggagtaggtaaaacaactattgcacagatcattgccaacaaactggaaacgcctttctatactttgagtgctgtgacttccggtgtgaaggatgtacgcgaagtgatagaccgtgccaagagcaaccgtttcttttcgcagtccagcccgattttgtttatcgatgaaatccatcggttcagcaagtcgcagcaggactctctgttgggagcggtagagaacggaacagtcacgctgattggcgcaacaacggagaatccgtcgtttgaggtcatccgccctctcctatcccgttgccagctttatgtactcaaatctttggaaaaagaagatttgctggaacttctgcaacgtgccatcaccacagatgccatactgaaggaacgaaaaattgaattgaaagaaacaacagctatgttgcgcttctccggtggagatgcccgcaagctgcttaatatattggaacttgttgtgcaatcggagacggaggaaacagttgtcatcaccgatgaaatggtgaccgaacgcttgcaacagaatccactggcttatgataaggatggagagatgcattatgacattatctcggctttcatcaagtctatccgcggcagcgatcctgacggagcgatctactggcttgcccgtatggtagaaggaggcgaagatcctgctttcattgcccgccggcttgtgatctctgcttccgaggacattggtttggcaaacccgaatgcattgcttctcgctaatgcgtgctttgatacattgatgaaaatcggttggcccgaaggacggattcctttggctgaaacaacgatttatctggctaccagccctaaaagcaactcggcatacagtgcaattaacgatgcattagagctagtccggtcaaccggtaatctgcctgtgcccctgcatctgcgcaatgctccgaccaaactgatgaaacagttgggatacggacaggaatataaatatgcgcacagctatgaaggtaactttgtcaaacagcaatttcttccggacgagctgaaagacaaacggatatggcaaccgcaaaacaatccggcagaacagaaacatgccgagcgaatgatacagttgtggggagacaaatttaagaaataagtgttcgtaaaataagtcactcccttctgtaagaaaagctaaaagcaaaataaagcagtaggaaacattataacatattaataatattgaaattgaaatgaagattgtagttttagacggctatgccgccaatcccggagatttatcctgggagggtatgaaggtgcttggagaatgtacaatttatgaccgtacagctccggaagaggtattagaacgtgcagccggtgcagaagcaattctgactaacaaggtaatcatcaatgcagaccacatggctgcactgcccgaactgaaatatatcggtgtgttggctaccggatacaatgtggtagacacagctgctgcaaaagaacggggaatcgtcgttactaatattccttcatacagcaccgcttccgttgctcaaatggtatttgcgcatatcctgaacatcactcaacaagtgcaacaccactctgaagaagtgcataaaggtcgttggaccaacaacaaggatttctgtttttgggacactccgttgatggaactgcgggaaaagaaaatcggtctggtaggactgggaaataccggatataccacagcgcgtgttgcgatcggtttcggtatgcaagtgtatgcattgacttctaaatcgcacttccagttaccaccggaaatcaagaagatggatttagatcagttgttcagcgaatgtgatattatcagtttgcactgcccgcttactccggagacacgcgaaatggtaaatgcacgccgtttgggtatgatgaagccgacagctattttaatcaacaccggtcgcggcccgcttatcaacgaacaagaccttgcagacgctttgaacaatggcaagatttatgcagccggagtagacgtgctttctactgaaccgccttgtgccgacaatccattactaactgcgaagaactgctacatcactccgcacattgcctgggcaaccatcgaggctcgtgaacgtctgatgaatattgcaatcagtaaccttcaggcttacattgccggaaaaccggagaatatagtcaataaataaaaagcgatatatccgaaaggatagaaaaggcttatatataaaaactcccctcatttaacttctctaccatgacatagagaattaaataaggggagtttatttgttcctacaagaatctcaattcgaaattctatgtggacaaagtattaatatgagtgtcctccttcatccatttctttctcggtaattttgtgacgatcgatactacgccaagcatagaaaatatatgcaattacgaatggaacaagaatagagacataggccattgtctttagtgtaaattcgctggaacagctattggctaaagttaatgagctttgcaggtctgtatatgacggataataagcggtattgttgtaccctgctaccagcaataaagataaaacagtcagtaccgtaccgattcccgtaaaccagattcctttatcaaacgtctttttaagcaatgtctttccaatgccgaaaagaaccagtaccacaccaatcaggaataaagccaacactaccggcatttcgataaagttagtgagatacttatatggctgcatataaatttcctgtgtatccggattaacggcaaagccatcagataccaatgtacgaatgacaaatgccaaaaagaatacaaggaacaaaactgtattatttcgtactgcacgacgacatttatcggtcagctctttatcatcaatattattaatgaaatagagagatcccaacacacgggcaaggaagaagacagccaatccaagaataacattccaaatgttggtcagtgcatccaatccgtgccagccatttccccaatgactgattaccggcataatggtatctgtcatattggccttattaatatagaaatcagaaccggtaaagaaagtagccactgccccaccaagtaacacaggacctaccactccattaatcaccaaaaaagtccggtatgtctttttacctaacagatttccggctttactctgaaactcataactgacagcctgcaatacaaaactgaaaagtataatcatccaaagccaatatgcaccgccgaaactggtactgtaaaacaaggggaaagaagcgaagaaagctcctccaaatgtaaccaatgtagtaaacgtaaactcccacttacgtccggtagaattcaccatcatcttacgatgttcctcggttttacccaagcagaacaacaaagaattacctccttgtacaaacaataagaacacgagtatggctcctaacaaggaaacgacaagccaccaatattgttgcaaaaatatatacatatagctaaaatattaagtaatgagtaataggttattatcaattctccggtccttttttaatagcctttaccataattccgacacctgcaatcagcatcactgtaaacaggagcaggaagataaagaaagtcgtttgtacagagcttacatccagtttggagatggcagccattgtcggcagcatatcacggatagcccacggttgacgcccacattcggcaaccacccatccggcttgtccggcgatgtatcccaaaggaattgtcagcagagcaatccagtgcatccaacgcatctggcttaaatctttcttatagataaagaagagaacgacaataaagaacaggatgaagtatccgcccaagattaccattacacggaatgcataaaagttcagaggaacattcggaaccagttggttcacatctttgatatatccgtaaccgaaatatggaatattttcctgtaatactttatatgcaatttgagcatcttcctcatgtcctgcactctttgctgcacgataggcagccaatgcaccgatagccgtttttccacgttctatcttctcggcagcagaaagagctgtcgatccgtctttctgttgataaccaccctcgatgatatttgtaataccaggaacgtagccgtctacattacgttctgcaaggaaagaaagcatgctggggatttcaaaacggaagaggaaaggatctttcccatcgttgtaagtcttcttttccgggttcaacactcctattccaaccagacctacattagtgccgccttcatacagaccttccacggcagccagtttcatcggttgcgtctgggcaatctgataaccggaaccatcacccgtccaaacagaaagcaacgatgctactaatccaaaaatcgccccaattttgatgctggcaagcgcaaactcacgattacgtttcttcagcagataccaacaactgatgccgactacaaaaatagcacccagcacccagccggacaataccgtatggaagaatttattgaccgctacaggtgacgtagccactgcccagaaatctaccatctcattacgaactgtatcaggattgaattccatgcctaccggatgctgcatccatgcgttggcaacgagaatccaccaggcggaaatcgtagctcccaagcctgtgagccaggtagaagccaagtggaaacgtttacttactttgccccatccaaagaacatgacggcgataaatgtggcttccataaagaatgccaaaataccttcaatggccaacggagcaccgaagatatctcctacaaaccatgaataattgctccagttcgtaccgaactcaaactccagaatcaaaccggttgccacaccaatggcaaagtttataccgaagagtttcatccaaaactgggcagtctttttccaaaattcattgcctgttttataatacagcgtctccatgattcccatcaccactgccagtccgagtgtgagaggaacaaaaatccagtggtacatggctgtcatcgcaaattgggctctcgaccaatcgatcagcgaggtgtcaatactttcaatcataatcctatgtagtttaagagttaaaaatcagtagatttaccggggatggcacgttctatcagttcgtttcccacgtatgttcccttgtcgtcatccgtaggatggtcacggaggaaatcagggaaaaagaacattttaaggatgaagaacataacgaataatttcagcagaatgataacccacagggtacgccccaaggtcatactacggaagccctccaaatagaagttccagatcgtaagcagtgtattcttcatatgttgacgttataatttgtaatgagtacaaatatacattttttataattaaaacaaacaactagtcaaaaaagttgtgtgatttgttgtgtttttcttcaaaaacctgcctatcgacagaaaaaaaacatttaacggcgaaattacgtcatccgtctatcgtttttgcggcatatataatatgtacgtaccttcgctaacagtaaatcaatagaagtatgaatatgataaatgtaagaagattgacagtgatgacatttcttggagcaggtatgctgtccggcatatctgcccaagtttctccgctgcaagtcgatacgctgaaagaaacgaaaattccggctcaatgggatttgcagtcatgcatcgactacgcaaaagagcagaacatcacgattcgcaagaaccggatcactgcggccagcacgcagattgatgtaaagacagctaaggctgccttgtttcccagtctttcgttctctaccagccagcaggtggtgaatcgtccgtatcaggagacgagtagtcgggtaagcggcagcgaaattatcagtagcaatagtaaaacgagctacaatggtaattatggactgaatgcgtcgtggactctatataatggtaataaaagactgaaaaccatccagcaggaaaagttgaacaatcaggtagccgaactggacgtagcgacttccgaaaataacattcaggaatctatcgcccaagtgtatatccagattctttatgcggccgagtctgtcaaagtaaacgaaagtaccctgcaagtttctattgcgcagcgtgaccgcggacaggaacttctgaacgccggaagtattgctaaaagcgacttcgcccaactggaagcacaggtgagcacagaccgataccaacttgtcacagcgcaagccactcttgaagattacaaattacaactgaaacaattgctcgaactggatggggagaatgaaatgaacatctacctccctgccctgtccgacgaaaatgtactggctccgttgcctaccaaaaaagatgtgtacattagtgcattgagtcttcgcccggagattgaagctagcaaacttaatgtagaggcttccgaactgggtatcggtattgccaaatcaagttatttgcccacaatcagccttagcgcaggcatcggaaccaaccacaccagcggcagcgacttcactttcggagagcaagtgaaaaacggatggaacaattcgatcggattgtctgtcagtgtgccgatcttcaataaccgtcaaactaaaagtgccgtacagaaagcaaaattgcaatacgagacgagcatgttatccttgcttgacgaacaaaaaactctgtacaagaccatcgaaggactctggctggatgctaacagtgcacagcaacgttatgcagcagcaaacgagaagttgaagagtacacaaatcagctatgagttgattagcgaacagtttaatctgggaatgaagaataccatagaacttcttactgaaaagaacaacttgctgcaagcacagcaggaacagcttcaagccaaatatatggccatactgaatacgcagttgctgaagttctatcagggagatcaattagcaatctaaataaaagcataataaacgaatgaaaacgaaaaagattatcttaatcgctgtggcagtcgttgtggtagcaggtgcaggaatctggttctttgcaggttcaccggccaagcacaaagtcacctacgccactgccaacgtgagcaaaggcgatatttcaaattcggtaactgctaccggaaccatcgaaccggtgacggaagtagaagtcggtacgcaggtttccggtatcatcgacaagatttacgtagattacaactcggtagtaaccaaaggacagttgattgccgaaatggaccgtgccacattgcaaagcgaactggcatcacaacaggcaacgtacgatggtgcaaaagccgaatatgaatatcagaagaagaattatgaacgtagcaaaggcttacacgaaaagtcactgattagtgatacggatttcgaacaggccctctacaactatcagaaagcgaaaagtagctatgatagcagtaaggcatcgctcgcaaaagcagaacgtaacctggcttatgctactatcacctcaccgattgacggagtagtcatcagccgtgatgtggaagcaggacaaaccgttgcttccggattcgaaactccgacactgttcaccattgctgccgacctgacacagatgcaggtagtagccgatgtggatgaagctgatataggcggtgtagtagaaggccagcgtgccagcttcacggtagatgcttatccgaatgatgtattcgaaggcgtagttacacaaattcgtctgggagatgcaagcagtacgagcagtacaagcaccaccactacagtagttacttatgaagttgtaatctctgctcccaaccctgatttgaaactgaaacctcgtttgacagctaatgtcacgatctatattcttgataaaaaggatgtgttgtctgtcccgaacaaagcactgcgattcacacctgaaaaaccgttaatcggtaataatgacatcgtaaaagattgcgaaggcgaacataaactctggactcgtgaaggaaccacattcaccgctcatccggtagaagtaggaatcagcaacggtatatctacagaaattatcagtggcatttccgaaggaacaaaagtagtgaccgaagctaccataggagcaatgcccggtgaaaatgtggctgctgaaggaaatcaggaaagtggcggagaaagaagtccgttcatgcctggccctccgggaagtaagaagaaaaaataattattcaatgtgccaatccgttattggcacattaacacattatttacgatgaaaaaagtaattgaaatacaaaatatcaaacgtaactttcaggtaggcgacgaaaccgtccacgcattgcggggcgtttcgttcaatatcaatgaaggagagtttgttaccatcatggggacttccggttcgggaaaatccacgctgcttaatatattaggctgcctggacaccccgaccagtggagaatatctgctcgacgatattcccgtacgtacaatgagcaagcctcaacgtgcagtactaagaaaccggaagattggcttcgtgttccaaagctacaacttgttacctaaaacgacggctgtagaaaatgtggaactaccgcttatgtacaactctgccgtgagcgcttccgaacgccgtcgccgcgccatcgaatccctacaggctgtaggattgggggaccgtctggaacataaatccaaccagatgtccggtggacagatgcagcgcgttgccatcgcacgcgcattggtcaacaatccggcagtgattcttgccgacgaagcgaccggaaacctcgatagccgtacctctttcgagatacttgtactgtttcaaaagcttcatgcagagggacgtacgattatctttgtaacacataatcccgaactttcgcaatatagcagccggaatatccgtctgcgtgacggtcaggttatagaagatacaaccaatccgaaaattctgtctgctgccgaagcgctggccgcattgccgaaaaacgacgaggattaataattattcaatgtgccgatatactaatgtgccgattggctgtacaataaacaagttgggagagtataccttcaggaaattgccccattagtatatggacaaattagcaaattattcattatgaatggaactaatttatttaagatagctctccgggcattggcgaacaataagctgcgtgcttttctaaccatgctcggtatcattatcggtgttgcttccgtcatcacgatgctggctatcggacaaggttcgaagaaaagcatccagcagcagatttccgaaatgggatcgaacatgattatgattcatccaggagctgatatgcgcggaggtgtccggcaggacccgtctgctatgcaaacgttgaagcttgccgactacgaagccttgcgtgatgagacaagtttcctgtccgccatcagtcccaatgtttcatcatcggggcaactcattgccggaaacaacaactacccagcttccgtgaacggtgtcggaacagaatacctcgacatccgccagctgactgttgaaaacggagagatgttcacagaggccgacatacagagttcggcgaaagtatgtgtgattggaaagactatagtagacaatctttttccggacggaagtgatccggtaggtaagattattcgtttcagtaaaataccgcttcgtgtggtaggtgtgcttaaagccaaaggctacaactccatgggacaagaccaggatgcagtagtgcttgcaccatacaccacagtgatgaaacgtctgcttgccgttacgtatttgcagggagtgtttgcctctgcccttaccgaagatatgacggattatgctactgacgaaatcagtacgatcctccgtcgcaaccataagctgaaagcttcggatgacgatgatttcaccatccgtacccaacaggaattgagtacaatgctcaactcaaccaccgatttgatgacaaccctgctggcttgtatcgcaggtatttcattggtagtaggtggtatcggaattatgaatatcatgtatgtatccgttacggaacgtacccgtgaaatcggtctgcgtatgtctgtcggtgcacgtggagtcgatattctaagccaattccttatcgaggccatcatgattagtatcacgggaggtatcatcggagtgattatcggttgcggggctagctggattgtcaagagcgtagcgcattggcctatctatatccagccgtggagtgtattcctttccttcgcagtatgtaccgttacgggcgtcttcttcggatggtatccggctaagaaagcagctgatttagacccgatagaagccatcagatacgaataattgattgacaaccgtcggttgtcaattaaaaaaattatctttgtctttatgaaacaaacctttacatccgcacgtcgtcccctggagatactgatacacattatcagctgggggattatgttcggtttcccgttcttcttcgttgaacgtggaaacgggaacattaactggatggcctatatacgccatcttgctgtaccactctcttttatgattgcgttctacgtgaattatttcattcttgttccccgttatctgtttcagagtcaggccaaaagatatatcgtctacaacattatctttttatgtgtcatcggcattttgttacatctctggcaaagcctgacattcgatccgtcatttgcacccaaagccaaaagaccgggtatgcctccgggatggctattcttccttagagatatgttgagcctcgtatttactatcggcctaagtgccgctatccgtatgagcgcgcgatggacgcaaaatgaagctgcccgcaaagaggcggaacgaaaccgtgcggaagcggaactgaaaaatctgcgaaaccaactgaaccctcactttctgctgaataccctgaataatatctatgcactgattgcatttgattcggacaaagcgcaacaagcagttcaggagttgagcaaactgcttcgttatgtgttatatgataaccaacaaacgtacgttcctctctgtaaagaggttgattttatccgaaattacattgaactgatgcgcatccgcctgtcggccaatgtacagatgattactaaatttgatattcagcctgacagtcagacgcttattgctccgcttatctttatctcattgatagagaatgctttcaagcatggcatctcccctactgaatcgagtttcatcagtattcatctttcggagaatgataaggaagtgatttgcgaaattcgcaacagtaatcatccaaagacagtggaggataaaagtggctcgggtgtgggactggagcaagtcagccgccggttggagattctttatcccggggcttatacctggtcgaaaggtatctcaaaagatgaaaaagtatatgaatcgaaattaagtatcaagatcagagagtagatttcaaaacattgaatataaaaactttagatataaaatagtatgatgttacgttgtgcaattgttgacgatgagccgttagctcttagcttgttagagagttacgtgaataaaaccccgttcctgcaactcgtaggaaagtattccagtgcggttcaggcaatgaaagaattgcctggcgaagaggtcgatctcctgtttctggacatccagatgccggagcttaatggtttggagttttcgaagatggtagatccgcacacccgcattgtgtttactaccgctttcggacagtatgccatcgacggttatcgtgtcaatgcactcgattacctgctgaaaccaatctcctacgtcgatttcctgcaagctgccaacaaggcccttcaatggttcgaacttgtacagaaaccggaagagatagacagtatttttgtgaaaagtgactacaaactggtgcaagtggacttgaagaaaatcatgtatatcgaaggactgaaagattatattaaaatatatacggaagatgcttccaaacctattctatcactgatgagtatgaaagcaatggaggaacttttaccttccagccgtttcatacgcgtgcaccgctcattcatcgtacaaaaagataagatacgtgtgatcgatcgcgggcgtattgtttttgacaagacatatattcctatcagcgatagttacaagcaagtttttcagacttttcttgacgaaaggagctaattattcatgaatttatcggtaaaaaagtgaattttgtcgattatagtttgccaaaacccgttttatatctacctttgcaacgaacagaaagggattgtgaaattccaagaatagaatagtttagttaagtctagtttagtttttgtgttgatcggaagcctgcgagcgagcatgagcttccgatttttattttattgatatacagaatattaaaagcacaatcgaactatttttcctatcaattagtagtctataatagagagcaaaaacgtcacttttgacgctataaaatggtcggattatggtcggaaaattcccggattagaatctgattataagtaaattacaataggatgttaaaaaaataatggtcgaaaacgccatttttaccctaaaaacacaaattatggctacattaacattggtaatagttcccgcaaaaaggttatcagacgggacacacaaaataagaattcgagtcgcacacaactctgaaacgagattcatcaccacggatatagtggtaagggaaaacgagtttaagaacggtaaaatagtacaccgtccagacaaggattttctcaatacaaaattacaacagctatacaacctttatttcaagcgatacatggaactggactaccctgattcgctcacgtgcacgcaattagtcaaaatgataactaacccgttaaacggagaaaagcatcgtaagttcgaggatatcgtggatgaatatctgtcccaaatagatgaagaagaacgtaccaagacatacaagctctatcggctggccacaaacaagtttatgcaattcatcgggaacggttctctcatggaacatattacccctatcagaatgaaccagtacatatcatggctcaaaaagacaaagctgtcaagcaccacaatcaacatctacataaccctgctaaaggttatcattaactatgctataaagatgagatacgtcacctacgatatcgaccctttcatcacagccagaattccatcagcccaaaagagggaaacgcaaatcaccgtcgaagaactcaagacaatcagggacgccaatttagagcattacaatctcaacgtcacacgggacattttcatgcttacttattatcttgccggcatgaacctagtagacatactagcatacgatttccggacggatgaaataaactacatccgaaaaaagaccaaaaacaccaaagagggggactccctgatttccttttccattcccgaagaagcaaagcccattataaaaaagtatatgaaaaagaatacagggaaaatcatattcgggaaatacaagaactatacctcctgctataacctgctggccaggaaaatcagtcaattaggcaaggtggcaggaatcaggcataaattcaccctatattcagcccgcaaatctttcgtccaacatggatatgacctgggaattcctcttagtacactggaatactgtatcgggcaatcaatgaaagaagatagaccaatcttcaactatgtcacaataatgagaaaacacgctgataaagcaatcagggaaatacttgacaacttgaaaaatgaataatcacatataaaataaatcactaagaatttgcataataaccaaatgcttattatctttgtagtgtcaaataagagttcttaattttaatgtttaactgatgaaagatgaagaaaaaaaagaattagaacaagagtatgagaatttaaaacttctcgcttcatttcacgaggtctatggggttcctgaaaatgccaaagaacgggaagcgcttataaatgacatactcgatcggatgaacgaaatccaagagaaattaaaaaagttgtaattaacatccctcccttcggggagggacaaacattaaaagctatgatagattggaatgattgcctgccaacaaaagaaatgcagtttgactttgaaagattcaaagaactaaaaaccacagaagaaaaagaagctttcaaaaaggaaatgcaggataaatataataaactaccggaagcccaaaaggaagcctacaaaaaagcatctgaagctgggctaaaagcaacggtaaatgcctgcaatgattatatagaaagagtggaagaagccatattacgtgataaacttggagaattgcccgaagcaatctcattcagttatattgcaaagaaatattttggtaaaagtagaaactggctatatcagcgtattaacggaaatatagtcaacgggaaaaaggctcgctttactgacaatgaactcaaaacgttcctgaacgctttgaacgatgttagcgaaatgattcatcagacatcattaaaaatcagttaagctcttatttgacaccatccctgcattgagccgatgcagggatttttattgtctaatcgaaaaataattgtatctttgcaacatcaagataatacggacataattcggattattttggtttgactttggtgagggggtggttcccctcactttttttatatccacgatcgaacttttcatttatatattagtactatcttatgtaacccttcttgagagtttgttgattcgtgtgttgttgataggaaggattacaaaaaaggcagcctaataagctgcctttcatttaccttcaatccaattatttacttacatcccaatcaaaagaataaacataaccattgataggtatatttatagttagaatctttcccttttttcttttaatgttcatatatcctattataccctcattgggatgtactgttgtcttctttagatatccttgcctttttatttccctatcattatccatcattttacccaatgtttgtagttgataagatgatgccatattagcttgaaaagccgcatttgcatcataatggttggtcactgttgtataagcggtaccatttgacgaatacgatgtggaataagatgtagaatatccggcacttcctgcactaagcccagaagaaaagccatataaggccatagcccagttttgagactttcttatctttttctgaaaagcttcatttgtgtataccattaattgataattatctcctctattagtcagcaaatgagaagtaacatcgtccggcgtaaatatgaccgacgaatcacactgattcttgatgaaaacatcaatccgataatattttccataatcatccttcgtttcataagtcgtaaggccaacgataaaaccattcgcatttctatatgcccaaagattcccatcattatattctgtcataaccgtagaatcattttctgatagaattaaagtttgtgctttggatattattgaaatacacgcaaaaagaaataaacatatatatttcataccttcaatataatttatataagttacatcataagattagattaaaatgtaaatacgaaattataaataatatgtgaaatatccaaaaagaatttagcagtaaaaaaaataatggagaagtaatctacgaatactagtgtattgtatttcctttttcattaccacataatcaaattacagcttattcccaccccaacataccaaccgcccggataactatatcctgtctgtaagcctaatccccaacgttttttcttctgtaaaggtgaaagagtaataatttccttgtctctgtacacctccatgaaatcaagactaggcttatatccactaactatggcccggtaattatcagttttatattccttgcttacaataggtacaagtaccggaattgaatcaccttctacggttctgtcagtcgtagtatctatcaagataggtaaatataccgtatcgatacgctttggagttctctttgccggtttgggtattgtgtctcttactgtgtcccggacatgtacagtatctcccttaatgtacacagttgacagatcgtgcagatgacaacgcatccacacgatcacgccaaacaatagacagactaatatccacggaagagacttcatatgcctagatatttacaaatgcctttcacatgaagagaaacaatagtccgtttcccctcctctgacagcaggaaatccacatcttctttgttatcctgaaacagattctccgtcagaacagccggacacttcgtatgtttcaagatataaaaactactctccttatctggatcaccgtctgccatatccttccgtattttcattccaaacaaacattcttcagcagtagcatacagacagtcagccagcttatcggcttttgtctgtcccacactggtccatgcttcccaaccacgtgcttgcatccaatttgaaccattaccggctgcattgcaatggatagaaataagaattgcttcagaagttttatattcattcactcgcctacaacgttctgacaaaggaacatctatttcctctttcacgaccagttccgcatcaatacctaatttacgcaattcaaatactacacgcccagcaatttcacgggtataggagtattcccttaacctgccatctggagaacacttacccggagtattactaccgtgaccgttatcaatcaatattttcatatctttcctctttatctagttcgttttcgattctatcaataattccttgtacatgtgtaggcgtagcccgcttaaattcaaaacgtattacatggtaaattatacgaaaccctttgtttctaggataagcaataatcagattcttaaatgcgttctgaagatatacataagaaaatacatacgtaatagtcttaataactaacaatgagttctcaccatctcctatcaagctcataaaggagaagactacttcaatgattataagatagaggagaagttcgaccaaggcatttttaaacttatcccacttaaagtttttacaacgtataattgaaacaccatcagccctcattccgcaccaaatattaaatccaaacattacaactaatgctataagaaaacctttagtcggcgttaaataagcaagaagagaactgaacatcgaaacgaaaataattcgtatctggtctacattaaataactcatataaccatctcataatattaatcataaagttactaccaatattgaaaacacagtaatcagcccaggaagcaaaacagtagctaatgcgtcaagccaatcaaagatgaacccgcactttttctgaatgtactcaaccactattgcggcaatggcggttgtcgttaaagaaacaatagcagatttacagaaatcaatgcctaatagaaggaaacagaaaacaagcattacaacaaagacgaacatcccggctttgacgtgtgccggtcggttagattgcaaaagccaatcatacaatacttttatacccatactcatagcgtttaattattaataaaatattctgtatggaacaaatgtattgagtataataacgagttttacaaaaatggaaaatcttggaaatcaattctatgataaatatctataaaacaagacattataattttcactttttccataaataaaaaagggatgcttgataagcacccctaaacaaccaacagattgaactattaatccgtaaacatatacacggaaagatcaaccttttctatttcgtctgaaattgtatctccatacattgtaagacacacccgataacggtcaatacttctttgaatctgttgcaaggtaggtttctcgggatattccgaactggcaaaagttaccagttcttcaccattctcactggtaccaaccacccggaagtgatgacgtacaatccaagttccgtccgactgttgctcgataggcttagcaatcccacgcggtaagatatttttttgatccatgttttttgatatgtttaattagttgttttctatggttatatttattcttcaatacaaacttttcaaaatgtccttcgatataaacatattcccaccattcaggaagcaacatcgctgcaattttacggcggatattgtacgttgcaaagtgtttcatcaggccataataagagttcatcgtactcacaaacttctcaacatacgcttctgcaaatccattttcagctattctattaaatttcctgacagcgttatatgtgttaccaaccaccctgttagatacataaattctaccaggcaaaatgaacgcccctacaaacaagactccttttttataatgctgaagatacagtttgcgtggatgcaaccgtaaaaggagttgttctttcaggaaaccatcaagaagatggactttggacaatatttcttccggtgatttcactacgatacaaaagtcatcaacaaagcgtacataatatatgaatcccagtatttccatcacgaaataatcatatacagacgccagaaagttggctatgagttgcgacggcaggttcccgatagccactcccctgtcagggtcattatgaaacagacttttattactgggaagtttgtcccacatggagacgggagagcgtctgatacacttattttgtggacaatgaaagatagtaacggctagaaggtaaagcagacattcaatatcatcgcctttataattgtcccttacgaatatgttcagcatttcccataccaacgatttcgagatagacatgaagaaactgaacaggtcatctttgaaaatgtacgcatcggcagtataattctcactgacctcgactatcatgttattcagatagtgcacggcagacagacatccctcacctttccggcagttcttcgagacgttcccttgttcccgaaaacgttcctctaaaatcggctcgatacgaagagcgatccagtgatggacaacacgatcaatgaaagcggcggcaaaaacctcccgatataccgggtaagtccgtatgaatacttttgaaaagtccggtacatattcaccgtaaataatagaataccatagccgcaccaatgcagactgataatcattatagaactcaacacaatccgtactcgttcttttctgcctggcacaatcttcggatgcttcgaaaatactgctaagaagtatgtcatagattatattacctgttgcggcgaggggacgaacccggttcgcgttctggcggttgttcgtgttgacgttgccgttgttgaagttcacgttccaactgctggaagccgttgcatccgctatcttagtctttcccggctcatcaccggggggatgcccaataaataattctaattgctcactcataatccccttggcgattatgactccggctttgcgacttgttgcgatccgttagctttttgccgttggagatctgcaaccgtttttttgtaccaaccggtactttgcttaccgatgctctctgcaagcagacagatttcggctgtttgagtcaggctggtcaaatgtcgttcttcacacactcttagcagtaatttcaatgcatcaaactcacacaaaaacttcatcagataatctgcacgatgctcaaggttcatatctgtatttgcataacggatatattcgcaacaatgaacggcaagcatcatcaactccgtaccaaattcataccggaacgccttggggaattgttgccgggcatcaatgataaggttcagaagcttatacatcgaatttgatataggaaggtcttgtgtaagtgccatgttaattttttaatattttaatgtatgtattagagggcacaaagttaataactgtaaagcaattaacacaattttagctcaaaaaagtgaaactaaaaagcccctaccgaggcttttatttagctaactttctaagggataaagaattaaaggggtaaagtgtttattgcggcgaggggacgaacccggcccgcgccctggcggtagggcaggtggtgacgctgccgtagccgaagtacacgtaccaactgctggaagcgtcatattcggtactagaccaataccagtcatttgtaaatatattttgattgccaaacatagaagttatgagctcattgatttcggttttatacttggccataagcataagttcacccaatgcgggcaggttccacacggttgtatcttcaattccgtcagattcaagcgtacaggctttataggctctggcaacttcggcggcaggggcgccgacagttccctgggtgtccttgacgcctgcaagggtttctattataacatcggtattttccttgccgtcgaaggtatcatagagtccttggttaccactgccgtagtttttcaggccgcgtaggtcagttccgtagccaccccatttgaacgttttattgccgcctgcgtcaacgcagtcgcttttggcgataatgaactggtggcattcggcgcgaagtcggatgccgatacggatatacttggagcgattattcgcgctcatggagttccattcggaagccgtgaaaaagacttgttcaccgtcttcaatccggagcgtagccaaagaaaggtcaagaagcgtacctgaccattgcatatatttggcgatgtcgcttgcgggggtgttttcattcacggttgtaaaacctattgattttaaggcttctatctggtcttgtttattcaagcgcagaagcatggcgctggcgatatttttatccattttattgtataatattaagttaatactattcggaagcaacagctctcacatgaagaagggctgaatttttgttttgattcgtaatacgcccggtattcagttcgaacgcccaggcggagttagtatcccaaattgttgatgaccagtagtatttatcagtcatcagcatactgtcactactccaaaaggtacgcatcatctcattgattttatcgcggtagcggtacatcagaagcatttggccggatgaaggaaggaaccagttggattcatcctcgataccgtcactttccaaagtgtaggcacggtatgcacgggcggcttcggcagccggcgcaccgattacaccgctattgttttggtctttcagaccggtgataatcaggtcggtatcttcctcacccgtgaagcagccgtacatggcacccagtcctttttggttcaggccgtctatggctttaccctgaccgccccaatagaaggtagtagtcatatcggcattatagcactcctgggcagcgattacgaaggagtgtccatgggcacggatacgaagcccgcgtttgatatacagttgcttattagcgagcgtaagggagttccattcggcagcagtaaagtatgccttggagttatccgaaatacgattacaggcaagatgcagatcaagcagaccggcggcccacttgatacgttgtccaaattcagatgcgcgggaattctcggtgacatccgagaagcccacggcgttcagtgctgccacttgtgcctgtttattcaagcgaagcagcgttgcgctttgttcattcgtcatagttacttgttgattaaatcattaatatccatattgtcttcagcgaagcgttcaagatattcttcgtaggtttcgccgttataatattcaaggacttcattgatgttgtccagcgttacgttatcgtagtacggttctccgccataagactcattattgaaccagttgattaggtcgatgtaggcatctatgacggtaaggatgacaaggccgtcaataccggattcaagggattcgatttcatccgtttcacggataactgtcagttcatacgtgccgttgactaccggtttatcctgtctgttgccgtcctcatccattccggcaactccatattcgagaatggcaagaagctcggagccgtcagccttcagggtcatgttcgagatacggagcatggaaagtttacgggatgccgcttgtgaagcgaagacgtcacggagcatctggatggcattaagtttcggagacgtttcaagacgtaggcgttgaacattcggcatggattctatttgcaggccagacgaagcggaaaggccggtataggtcaattcaggcaggccgacaaaacggaggcttgtcattgttgctggaagagagatgtcattaatcggagaagtctctgcaagagtgatgttctccagtttgctaccggacgcattgatatgggcgatacgtgggcatttgtcggtaacgagcgtagcgatttgtgtgttccggatatcgagtgatacgaggaagggcatttcgccgcagttcagcgaggtaaacggtgcgtaagaaccgatggattgttctgtatgggtgtcagagcccaagataagggtttccacaagttgcatggcggagaagctcaccgtacttgacagggagatttcagacaggtcgagcagcttcatgcggtcagcctgatagatatacagcagggcgccttcctcatgtgagaagttggtgaacacatattcttcgcccgcttcaaggaagcagctttcggaaaggttgccactggcatcattgccgacaccgaagtaaccgtttttagcggcgacaatccggatggtggcgtttggtttggaagatacgcgcccggaaattacaccgctgaagaaatcaccggtttggaaatagccgtcacgaatacgccaacgtctttcaatgaaggacggaagggcggtaagtccaagaccttgcagggcatagaagtaaatagcatcagaggtcgcggtataggagatgtatttccgttcaccgtcgtaggaactgaccagtttctgccattttttgagccgtttgtcaatgaagaaatgcgtagctccttcgggcgagaacgggtgcagagtaacgccgtcgatggtcgcctgaacattacgcatggcggcggcaacggtacgcagagacaattccgtaccggatgagtcagtccacactgtttgttgaaggtagatgttgttgaataatacggagccgcatccggcataggggttagtgaatgtttcatcactcgtccggttggggtctacctcggcatctaccgtacagccaccgtcgttatccttgctgttgagcgtatcgcagtcatagattttattcaggtacatgcgcatggcatcctcggagctgtacacaccgtccgttacggaagcgtactcttcgaggaaccacatcggttgcatattcttggcacgctggtccgtggcagcaaggtagtcggtgaagatgtcataactcaagacactttccgggcaggcatatttatacaggttttctttccatgttttttgccagttcccgcctttggagtaatcacaggaatcacagaagcgcaaccaccggtagaggttatagggcactttcttgccaagcgcgtaatcaatggcgagctggtcgtcatcaataagtgattcaaagtagtaggtccatgccgggaaggtatcggcagagatagttccgttatccacgagtttctgaacccatgaggacttgtccgttttcatggccatcatgtcctgaacggaaccgacaccctggaaccagtccattccctgatagttcagaagctcgaagccttcgacgggattcaggacatcgccggtaacatgccatttgccgttttcgtacttcatggagccggactgctttttccatgagccgtcctgatacctcattatccggtatgagctgccgcaatacagggatagcaggtacggcttaccggtatcgagtccgtcggtctgtttgaaccgtgtttcgatcgcgtccaaagtctcgtcaggagtaccgaagaactctatgaagtcaccatagttcaggcagcctttgttatagccgggggtatccttgaaaccgagggcgaactgttcacccttgtcttccttccagttgcctttggcatggaaatagacgttttgcaggctgtcatccttacaccggtaggtggctaccgggtgattggcggtggagtggttcatctgcaaaccttcgatatgcaggtcaccgctgtcaaacgttccgtcaaatgcacgttggacgggcgtcatatagttgccgcccagggcacggtaagtaacgttcatcatttcacaggcgccgcagtcgttcgcgttgccggaatcggagtaatcgacttttacggtgatgacatcgaccgggattgtattatcaccgacctgcactttgttgatggcggcaagagcgattgcccggcgtccttcctctgtcgtatcgtccggattaagcaggatgattcgggtatccttgtttttgcctttgctcttggcgaggtagtagcgtttattcttcaccgggcgtttggcagaggtggttccctggttgcgggtttggacgctcactgctttgaagttacgccacgggcgttcggggtcgaagtaatagagcgtgatgtatatcttcgtactggtggaagtggtgccgtccagtgcttctatatcggagccttcatagggacattcgacaatgtaaggcataccccgtgaatagatttcggcagccgacgggcggctttgggtgctaccctcggctgtctggcttttaaggacgtcctcaaaggcgtattctttcaccattacttcggtatcggtcagacggacaaggtagttcctgaacgcttgcgcccattccatataggagttccaggccatcatgtaataaaggtacaaatcacccagtctgccgtccatcgttatatacttggtttgaatcagggagccgccgcccggaacataaccaagacaggcgacttcctcaccgttgaggaacagtttcatcatggaataccgtgtgccgtcacgttcaacgtagttgcttgcaggttcgacaaccacgcctacggttatcttttcaccctgccggtaggcgcgttcttcacgacgggaaacgccattgttacagaagatgccgaccactcgtccggtgacatagaagccggcaccggacgtttcatcatagcagccaaggagcagggcgtcatcatcggtcacgttcctggaagcgaaagcgaactggatggcggcaccgttggattcaatagacgagccggcaaacggggcatggttcagtgacacgcccacattctcggccacgcgaaggcagttttcaccaaggaatgtgccgaagccgttggtagtccagttggcaccgctcaccttcatttcataattgccgctgacaatgctatggtcggtttcctggttggtacgggatgagaagtcaaagttatagatggcgccttcctttatggcggcgtcaatggcggaaccgctgactgtaacccggacaggctcgctggttacgtccttgcatacggcggtatagttgaccgtatcggtgccgtcagccttgtagccttgcagttgttgtttgacctgataggttttgttgcggctggcggcgatttgtgttacctgcacgtcattggctttcacgctgacgggggaagtcatttccaacgggtcatagcaggcgatatccagttctatggtttcgtacagacggactactcccccgtttttatcatcgtatcgtaaggctacaagtgggatagaactgttcgggtcgattaccatgacagccgtatggatgatattgccttttactccggaagcgacatcagttccctggatacgcaacgggtatgcaccatgttgcaggccgagggaagccggacggattacgacggagtgcgagtagttgtcatttacaacggcggtagacagggattgccattcaccgttaatcttgatgtcaacttgggcgctgatacctttatcagaggtattgtttccgaatttatataggggaaggctgaaactggcggttgtaggggtaagcagggtttcaggggtatagttgagcacctgcacgcaggtacaggttatatcgacggcggttacgttgacattcttggaaccggtattgccgctttcgtccgtggcggtcagcttgaatttacgggtaccggcagccgtaaagtatccggtgaagtccagttcaaaggagaagtccttcatgtcaccggaagacgccttgttgacggtttcagaccagacggtaagcccgctttcgcggtctacgagttccagtttctctatcaggttgtcagaggattcgacaccgttcgaggttacggagcggatggcggcaaaggttcggagcgtggagccgtaagagccgtagacgggtgttgactggaaagcgatggcgacaatggtaccaccggtctgaccgccgccacccgtgccgatggcgaactgcacttcgtcgccgagggtatcaccggcggcgttcttcatctggagttttacgatgccttctgtttccacgtttacgtcgaggttggccggaacataggcataggcgccaccagttgaaaaggcgtcctttcccccttccgccggttcatcggaagtttcaaaaacggaaccgccaccaccattcccgaagggtttccaaagagaaggggtcgcaaaatcggacacagcaccctggaactgccgggtttccatttcatactcgcctgttttgtaagtaatgatgagacccgttcgctcatatttgacgccagattcctgttgataggagacaatggcggcaatagcggtttcaagggtatagtagccgtctttcaatgggcggatctcatcaacaatgacgatggggtgtgttacatcgtcagcgggcgtgccgctcttcatatcctcaagggcttgcttatcctcggcggacaaaaggccggcttgttcaagggtggcggaaggcagacggaagctgtcgcccgtttctttaccggttgttttggacactttcttaaaatacacatcgagataggaagcgtcagacaggacggagaaagaacccggtttgattatatcggaagggatatttttcattgtatcttccaaagactttccacggttgccggggaaagcttcttcttcaccttccccaagagacaacggttcaggcagacattcagaaggaactttactttcttcgttcaaaggagcgataccgttcgcttttcctatcctttcctcaaagtcatttattacagaggtccatttgccccatgtaacactctcattggaaacaatacctattcgtgagattgtacaaactgtacctaaatatacaccttcggcattgtctgacatggtagccagttgtatacacgaagtgaatgattgacaaaccttattaagctccaaccgttcaatttgtatatttacaggaatcttagacgaatcaacagacaaaatacaccgataattcccaatagaagaatccccggaatacattgtttttaatttatctttaaagctaccaatagtagtaaaagagccaatacttttaaatgggtcagtcaaaggattggatttatcagacactcctgttatacgtttcaataactcggcgtctccatccgataaatcttttgcaatcttattgacattctccactaatgcatcaaaatcaccattcaccattttagcaatggtacttgaaagtaaatcaatagatattttccgaccgccactaacttcaacgtacatatctttggatagctctgttgtatcagtcagttgctctattgtaagactgtttgtcttcaacgcttgtaacacaaggctaataatctgttgtttttctgtttctgtcataattctcttttttaatcattttcatatacccatacaagctcaatggtcataccaagattatctatgtcgcaatcatagacattatcaagataaagttggaactccttcagagcaccaatatctccaccgttaatacctttcaagacacatacaccatccctactgattacactcccttcaatgaggttagtatacgaatctcctttatatagtacagcacgcaaatttatcgaaccgttgtccaaatcgttctttagtctatccagtccattaactgtaagtttaccgtaacctcttctaccaatatacttgttatctatgtcagtcgtcttgattgcaatcaaatcccaatatgaattttcatcaacacctgggtgatgaatactgttgacagtaaccatagtatcactattaatagaaactccagtattaggaatagccttagtcatattgatatatgctccgacctctgcaaccccactttctgaaccatacttgatactacgcattccttcatcatctgctatcctataagcaccgctttgtacacacctcatagcaagctggttattccattccaaaactggattcatcgttcttaccttctgtaacatttgattgaacacaaaactcttcaatccctctatttgctggttaagttccggaacattactttcctttctggtatatcgaacaccatcaaagtagacgtaattacagcataagacacgattcaataattcagcaaaccacacagggcatcccatcccatttccaagcgtgaataatactgttgtatattcgtggctgaatagctcaacaatatcctcatcagaggtcacgaactgctcattatccacaccgaacgtccatccgttatctttgaaaccaccaggaacgcgaaaatcaaaaaagtattgcatcccatctatccaccagacagcatcaagacgctgcttattatctttcattgaatactgaataaggctggtttctgataactcacattcatcgtccgtaactttaaaaatctcactcgtattcccattaactgttacagtatagtatccacatggaagcaatgaaatgttatagaaataaagaatcttatcatcattcatcttccatgagcttaatgatacaggtgtagatatattacttaaaagattattaatgtaaactataggctcctgctctttggctgtcaaaatcaattcaacaaaaatcctgtctgtacgtgcgaataattgcacatatttactcttcgctccaaatttatcggtagacggagaaaaaaacagtggggtaaacgggcttataatcatatttctaggcttttgttattgaacggacaaataaatcatacttcactccctcgtttctctcaactgtactactcacctctttgatgtaaccttcgtaaacaaggccacctttttgaatcttaatcgttccatcatctgtttgtggaatatcctcatcaaaggttgtaaatgaaacatctccacaagtgaccaaatgctcttcaagtataaagtcatcagttaatttcacatcattgactataacattgctattcccatccgaagaagcataatgaagagaatcagcgaacatgccaatatacttagcattagctttcaacatagctttctgccaatacataacattaaacattgcatcaggatttagaacacctgcaatcttccaatccgcattcctttctagtacatattccgctttcccaataaccttattataagcgagcattgcgccaacgataaacacatcattatcactttcgttatcagtagaactacttccccttttctgtgacacgatttccaagccataagcatctgcacgataagggctcactaactctagtgtattatctgttacttgcaatccagtagtatattcagcagtaaatcgaaattcatcacgaccattcaagcattcataatcaactttatcataaccaactttaactcgtgcatatatcctagaactgtctactttaaattgaaaatctgaaatgtttcttgatatattcttattaccattaaaagtaaataagctgtcacgatggacaaactttacaatatccccctcaatcctctgaacaaagccaaaacaggcttccatccagtctacaaacttcgtatatgaggtatataatttagcagacaatatcccacgaatactttcggcagccaaaataaggcaattgtccaaccgattgtctacaccggaagctatctcgccttttataccctctttaccaccattcatacttttgagcaaactattcagaacagtaataggttttaccacatctatattgataggtgatgctattgaagtccattttatctgtagtgaatatttagaaaaatacacctttccaagtccgttaacattcatattacctatcggatcatgtatgacaaattgaagacattcaccatcttgaaggtctattgcatagacatcccgatattgttcgggtctataagtgtctttttctgttgtatgtgtatttcctgaataatcggtatttatccaactcgcaatagtgcttgtggtaccgttcccatcaactttagcaagtgtcaacattacatctcctctgcctaaataaaagttaaattcgggggttatatataccttgactggtttatgcgcccttaaaaaagcaggtacagaagtatctaaagtcacagaatttatttctacaggactatctgattctggtaagtctttttctacgacttccaatggaagagactggaatatagtttttcctgttatatctcttgagaaatcaacatattgccctccatcttctaaagagtatccaccacatatatagttcgcgtagtaattaaacggtagtctatcataataaagctgatatgtatcttttatctcatctaccgaatattcgtactgcgttcctttgttagcctttatgatattagcgacactatcatctatcgaattaatagaaacagtatttccatcataggtcaatgaaccgaaatccagtcggcaactgaagaattcttcataagtatgagaattagttatagtataaacagtgatactagcattagaagccaggtatttgctcaaatactcctccaatatgagaacataggcttctccaacaaactggaactttgaagtaaaagttctagttatcccctcaagcccggagcgtttacgggaaaactttatttcatcccaattctgaatacaagatttgggaatattataggaaatactatcaacggtaagcacatatttacaaagcattttaactccttttgaacgttcacgagcaaatatatagaaaaagccaaccggtttcccgattggctaaattcttgaaaattacgatttgccaaaacgccacataaccaattgattttcaaatcaatacttatatcaagaaataaaaatgacttttcaattaatccccttaatacttatcgtttactacatcaaaacaatttaacgacttctccacatattttacttatctattctctgccactgtttccataccacgtgtagtataaaagctattgctcctgctattaaaccatacctagtagctttcattacatgagtacgagtcacggttttgtcatttaggtagcctattcccaatgtaatacaaaaaacaactatagcggtcactattcctgtggacgaggcggtctcgcaatcaaataacagtgattctttagtacatggtcggttcgtttccctcacctttgaataggaaatttcactctctagtacccgacttgctgtacccttcggtacaagaccatccctttcctttttactcaattccctgcgcaaaggttcggctaactctctgttagtaacaatatattgattgggataaccatttctctcttgtattttgtcagccgtcctttttgcactcaagctacatttacattgataatctacaccatctacccgtacatcaggaccgccccatttattagtttttcctattcgcgcatctactacctttccttttttacgttctgcacggctgaatagatcttcaaaagttttaccacctcctgtacgatatccttccttgctcttacaattatattcagtagtattcagattcctttctgtccgagatgccgcacataccatggtcacagtactgacactcaccaaaaacactccttccgctatattactgacgcctttatgtatcggtgtaatagttccatcatctttgataaagtaacttccaaaagcgagatgctcaatacagacatcgcatccttttgctctcaactgacgacttacgtcttcccgttctcgcacatttccaaattttattaatactttcattttataattttatctttaaatataacataaaactccttttttcatgggaagctataggaattttcataactcctaaaacgcacgaaaccaaaacatgacattttaattgtcatattctggtttcatttataataatgctcttatagctaaactactgaactgctctattttacattttaaatcctcctttccttatacttttgcgaaaataatatatatttttaaataatacaatacctcaatcttgaaaaacagataaatctttattctacaatttgaaattcaacactatttaagccatataacaattgatttttctactgcatggcagatttttattaactataaatccggttagtatgaatctcacacaacttactcaatacctaataaaacagctttattaatgaggattcaaagcttacagtccgctatcattacaatataaattatacaggccccttgtagatttaattcatagaaaaaacagtggcaaccaatatacggtcacaaaattttcaatcttgaaacttctgaattcctacttatcaacatcgaaattaaaaaagggttataactgggctttgtaatacctttgcctttattagttgtactggcaagagtactagtataacttttgtgaagtttttcttctgaaaccttttcaaacgctatttaacagtttaatagtttatttcctgaagtataaacttccgagcagaagaaatacgacttcttacagttccaacaggaatgttcaggatttcacttatctcatcatatgaatacccactagcataatacatcacactatcaatacaacgggattttttagcacaccgttgtattgtggaaaccaaatcatcaaacagtattgaatgagctgtacagttagaaatggcacttccgtctaccatatcaagccctgtaaaatgtataagggaatttctattgtatcttattatataagtattcctcattataataaggcaccacggttgaagtggtttagaacaatcaaatttatcacgattcacaagtagcttataaactgtatcaccggctaagtcttcagcatcttgcatggaacagcagaattttcttgccacctttaatatccaaggatatatttctgataattccttttcaaagtccattgtcagccctccttattaggtgtatcttcggttcgccattaatgcacctttccacatatttccggtgcatgatactttgttcgtgcatttccttagcagaacgctcgattgaactaataagagtgcctatatcggggggcaataaggcaatcattttttttacctcggacacttctgccgttatccgattacacttcgtctctaatgtacgtaattctgacaataaaacattgtataaatgcctatttatacaatggatgctgttttttctattcataaaaaagtcgtttgtgattctaaaggagatgtacaaacgactgtatgaaataattcgctttaattaaaaattaatcgaattacagcatatatgtaataccaatattatcatgtgcttctttttctgatcgatatttcaacatcagcttgatgaacgatattcgcatagacagcagcattaattacgcgggaatcaatactcattttaaagaatgtcattagaaaagcaatctctgcatcaaaagaagaacgaatttgttcaggagtagccttacttcctttatgttcctcactgcgtctctcctcattccgtttttgctcaaaaattgcagaatgaagtaaataatcaagcttcgatataacttgctcatcactcatatcccggatatctacatttagttggcccaacacctgacgaacatcatcataaaagccaagagaaacaagagtctgacatatacgaaggctcaatagtttggcacgttccttcaccatatcctctttgtccataatcatagcctgcatacctgaaggattaacaatgcttctgtattcgataattaatttagatgccatctctttaagcatgctttcagacacagatccgcgacccgaaagcaaacaagcatagtttccacatgaaagctcaatgaaatcattcaatgttatctgatttaatctttcaatcatagctatttcagtttagacaacttatacagttcaaaatcacggttagacgcatcctgacgctgcattttaagactcttcatcaaaaggagatttgttctatcaactcttttttctaatcgggaataatcattgaaaacaatggtgtcaccggaagaagatgcaaaatatgtcggtgaaaatgtaggaaagtcccaatccggcatatcaaaattagagatatctaccttatcaacatcaggaaagacttgtgcacctttaggaatatcaactaaagttggagcatcaggagtaatccatgcttttccagaatacatgataacctcatgtttaccagcatcaccaactaaagcggtaccgccaggatgcctatcattacctttagtaccgtctgcataggaaggaataggagttgcaagaatagttgcaacctgaattgctcccatggcaccaataacaatagataaaggaatattcggtaaagcttcagttattgccagtgcagtggctattccagcttgagcgacactagtcgccttttcccaaatggcttgtttacgtgccatttcttgtttttgtttttctagttcagcattttttgcttctgtcaaagattttgcagcacgtttacgcgcttctgcttcttcttcggaaatagcacctgactctgccagtttatcaacccgttcaacatctttatcatatttttcatcattagcatcctgctcttcctctatcttatcaatttgagcatcataaagtgtagaaacaagatttccaatagtccctacagcttgtgatgcagtttgcaaccattttttgagattcttttggcgttcttttaacgctttatcttcagctttagtaatattttgaatagcacttatctgtaattctgcctcctttttagcgagagcagccttcaaaacatacaactgagtaacaatcttagtacgttcttcagcagtaatattctcaacggttaattccagttccaaagcttcaatcgctgcttcagtagtcttatgtgcatattcaagttgtaaattgtattcctctatcgcatattgctcttctgttattagcttggatgctaacttctttttaagagcaagcatatccattacatacgcagcgtcacgtatctcttgctcatgggctgcattttccgcaatcaatgctacctgatcagaagcatactttccgtaaatctcttgttttttcctagcatatttttcatctatcaatattacatcttcacctgttttctctgctgcatcaatttctgcttcacgttgcaattctaactggtgcaatttcaaatcaagttcttcctgggaccccttttttacaacagcaagagcgttctcaacatccttcttctcacgatcagaattatacttaatagtaaactcatctagcctttcctgcatttccttagctaaattctgacgtgtagcaatttcctctttgctattacccttgacggcagcaatcttcttcgagtaagcaacaccaattttagcaagttctttctccagtccctcatccataagagctagttctgactcctgataagtttcatgaattttcagcttctctttgagagctttttcctgttcacgtttttctttatcagtaaggactgttatacctgaaccatttttgtcgttaccctttggacggaacttttctgcaatcacatcaagtccacgattaaactcatcgctagatgctattttgaataagtttttagaaaattccaactgagccttatccgctttttctgcttccgacgtgtaatagccaaacattttagcagcaccattctttatccaagacatatcttcaaactctgatgttgcatattgagcacgagttttcatccgttttaaagcttctctctcttgggccgttacttcaatacgtttatttttcatttgaataacagcttttgtgtatgcttgttcctctgtatcaccagcatcaataagcctcttatattctgcctgaaaatctttttctacttccaataactttttgttcgcatctttttttgcaagtgttctaaaattataatctatcttttctattttttcttcaggagatttcaaatcattggcgatacctcttattttatcagccatccaattaagaaactccttagcaggtcccgttgactcggagaaagaaagcataaacgcttcccatgctgaagataagttagcaagagctccatgaacattatctcccatcgtgtgagccatatcgcccaattcacgttctacaccagtaatctgttctctaagtggtaatattttatcaacagcggtgagaaaggcattaaaagcggcaacactacgcttatcagttaattcaagagtagtattcaagtctacccctttttcttttagcgatttcaatccttcaactaactcaggcaatgttttaacgggcttacctaacgcctttgccagctttccattactatcagctaaatttagaaaaacattacgggtagcagtagcagccattgaagcatcaaagccggcatccgataatttacccaacaaagccaaagtatcttcaatactgaaattaaaggcttttgcaaccggtccaacaattggtaatgcagtagcgagatatgaaaacgacaatgcgcttttggttgttgcgacagccatcgcagacacatatctttcagtttctcttgtatcagcattaaacatacgaagagaagcacctgccaatgaagccgcatctgctaattctgccccggtagcttgtgcaaattttagaacgtgctctgttgcatctaatatttcttttcgagtaaaacctagtttagcaagttctatttgcaaatccgtagcttcggatgcagtgtatttcgttgtagcacccaaacgttgagcatccgcagttaactccttcactttatcagaagtggttcctaatattgcagcaagcctactattagctaattcaaatttaacaatatcacctactccttcacgcagttttgtaaataaagcaacaactccactaacaacagcttgtgcaccaatatatccagcagcccaccctttcaatcctgcaccaactttgtttagcccaggagccatctccgttttaagcatcattccagcattccgggcaataattcccatgttctgcatggacttattaccgttctgtatttcaatccatgccgcctttacttcttcccgatatgcaccaatggtcattttctgttgactatatcgatcggaatttcgctttatgtaatcagtgttgattccaatagtagaattaagacgggcaagtgtacgaatatagttttcatccgtatctttcaaaacatcaacagccttttgtagctgcttattcatttcctttgcttgtgaacggctatgtacttcctgattagtcaaggtaatagcagttctgataagttttaaacgttcttcttcagataaaacagctttcttacgagtagtattaccggcattctgcgcttttgtcaagttagcttccgctttaacagccttttccaaggacgcagcattatccgagtttgccttggttagtttcttcaattcagcagcagataatttctctacatttagcttttcctctatcttcttactgacagtttgagttatttcagactgttttctaagagcctcggttaattcagcagatgcagagccagccgtttttgcttgggtattataaagattactcaacttttcaagatcagcaacgccttctacatttagtttcaaaccttttgctaattctttggccgcattaacataatcagccctcacacgctcaatagtattatcaagctccaccaatttctgcaaatcgttctcatcaacgaaatcttttaattttaaatctgccataattacaggtaatgtctatattcaacaatctttccttttatctcaactcctagtttatcaaaagcataggtaccatcttctttctgataaacgacatacatgcaaccatccaagacagctgctttctttgcaagatcactgatacgttccagttcactctgcatcttttttatttcgcaactacaagccattttctaccgatatccacattctgaaaagaaacgttccatccagggacggagatacataatattaaagtactctttagctgtatcaccaatgcctaaaatctgctcaccgtatttcttctcaatagaactaccgtccgtaaatcctttcgttgagaatcgaagcccggaatcaattctatcggcagttatgctatcatagaaagtaccagtaataaagaggttaggtacctcaaccggacgcggtggcaaataaagcatctcacttctaagaggtggagttatcctctccttccatcgtttatattgttccgcacggttctgccagggaccgggctcgttaaaataggtgtcagtatcataatcaggattcaatagatgttcagtaccgtccagaccggaatataattgctcctgaatgcaatcaacgagcacattcttatgttcttccatacacctaatacattcctcttcaaacccggatgcaatggaatgaataactctatgtaattcatcaaaatctgccatacagtaaaaatataacgggccgggctgtaatcacaccccagcccgtcggttacttagttatcgcatcgtacacttccgagagcttcttcttgcggtcagcttccttcagttcctgccacacgactttaatgtgcgcattaataaactcttccttcgtcatgcccttcacagcaacctcgacgaacgtaacattatctaccttcatgacacctgctcaatacctctgattcctttttcatacaatacagaaggagctttcaacgaaggaaccgccccagctttaggaacaatggtaatgataccatccgaatacgtagcagaagttacgttattcataacttcagcagcaccatcagcaataagactgccaaattcttctgtacggtcataaccaccaacaacttcaactattttgtaagtattttcggcctccaacttttgaaacacaacatcaaccaagcctttaacgaaattcttgggattgaagtctaactgcacgtagtcaaagtgcaattggctgtcttccacatcttcatgtgaaaaactaacagtcatcgcagacttagcactactggtcgggtactgtgtcacggtcggataaacagtagacatcggaataccggcaaggatatcagtgtcatcattataaccgatcaacatattatcctgattccaaaagtaaacgtcccatcctttattggcacatttcagaagctgggcattcaaaacctcatcaaatttcttcaaagtgaaggtgtctgtttgagcgctaagcccgttgtattcacttgcaccgtaccctacaggattaacttgaggctctccaccattcttggcatactccaggaatggcaaaatagggtaaatacgcccgggacggtctgcatggcacaattcgagcaacttctcacctgttatatcagcagggagtttgacaccatgttctgtcaagatagcacctttgacctttttccagtcaatgctacaagcagaactaccagtgttcatccgggaacccttacacgttctaatctttctcattttcttctacaattaagattattaatttttatttccatcgagcgtatatttatggcatcaatcggctcgctcacagcctcaccggaatctgtataggctccgtatctgccatatgaatagttttctgaataactatgtttcactttttcgtcatagtcgcagtcgaaccgagaatcttcatataatacttccaataaacgtttatagattggccgaaggatatttttaaaagatgtggttctgcgcatctcattgctccactctttacaagaagaacatgctataattaacgaaacctttgcttttgaaaaataatccgcatcacctctatcctcactaattggagtgaatagtgcaaccaatggaaacttcctttcagactgggcagaagacttactgtattcatctaaaatatctttgatatattgactgctaccgaagatgtaattcaaccttggggacttcataactttagttccccctttcccatttggatagagaatttcaagcccttctggaagttcctttacaatctcctcaaacagttctgttatatctaaatctatcataaattgaaagcattaattggggtcaaaagattcttggttattttcacatcgaaaggacaatcattcgacatagcccattcaacaaactgtttattcttctctaccatgctattccatgtgcttacttgtctcttcaaaggagctatatattcattagcacatttcaaacggacaagcccggttattgtagcctgggtgtttgcgtcacgaagaatatgataaaagacatagtcagcgaacggttcacacagcttctcgcataatactgcatatccggactggggggcttccttctcttctgaaatatcaacttcatctgaagaatcttccttttcccgttcaataagctccaaataatctgtgatagcttgggaaagagtcacaccaacaacattccggagaaattcgggctgaaatgccttaatatacccatttatcacctcattcacagcaagagattggggcgaaggcatttcagcgaccgaaacattctcaatatgcctgggacctgacataaaatatgaaacatcaatcaacatagcgatagttatttagaagtcttgcctttcccggttttcttttcatcttccacggaaacggctttatcatctgtaacagttacctccttggcatcttcctcttgcaaatcttttgaatcggcaaccggaagattcttttcatcagaaggcacctgtacttcaagttctgcaatgcgagctttcattgtttcacgctcttctgtcagttcaacaattgtcttatctttctctgcaatggatgcagtaagcctgccaatctcttcatttttctctgcaagcatacattccaatgtctttcgggcatcttcttctgtaacaagaccacattcggaaatagggatgagttgaatcatccctctattaatccgaatgcgttgctctttaagcacattggttacatccttatcgttacctctaagtatgtaatccataatcctacgctttagttattgcagtcttcaatgcggccaaatccccataagcgaaagcccacggcatataaatcgggaagataacttcttcttgtgccatcagcacaacctcattgcaaagcttggtctccacatcttcagcccattcaagtgtcaaagtggtataatcaaccaaatttgcggcttggttaaagtcacctaaaagatacttacctggaagaatgccaccatactcgataatcggacgaccggcaatatatttcaccccatcaaccattttaacgataccaagattacgtcctgtcgtatctttctctgattccataccgttaacagtcattggattaagaataatggcattcggaaaatactgggcatatgtcattgcggcgaaagctgttttcactacatcttcagagttgggttcctcaatgttcttaaagccggcttcatgaacactgaatgtcattttatccgtagccgtttcagcaccggagaacgcgacaccaggaataaggatacgaccatcttccattttcacaagagcgtgtgttttgttcagttcagtgagaacagcagcaccagcgaacgtgatactcattccatcaagaatcaaatcctgtggttctgcaaactctacaatcacatccttatcaccgttatatccggtaatagcttttacagcaccggcggcacctgtaacaatggctgtactgataatcttctctacagaagtcaccccagtattattaataataccaagcaaattctcaccattaccgtcaccaaacaagatgttccagtcttctgccatccaaacagcttcaggaagcatgttcaagatgtaggaacgaatgtacactcttgatttcaacatacgttttgaaatacggatatgagtaccaaggcgcttagttcctgtctgtatctcttttaccttgatacttgattccggtaaacgaccgttctcagttacaaaacgggcattacggttgaaagcatatacttgcgcataggcgagttgaggatatgcaggatcagctgtcagcgtcgttaatacatcacgcatatgcaactttttgttggcaacctgagtcacaacacgtttctgttgttgagtaatcaacaaatcaccggtgtagttgtcagtcatggaaacgacatctttcaaggagaagccgtcaaattctcctgatttgcgtgtttttccttctgcgaaatctctgaatttttcagaatcaagcatctcgttcaacttctcatcgaacttgttgatagtatccatagaaagacctttctgcttcattttctcgatactttcaccaagagttttaacttgttctacaagttgctcgttgtcctttaccaattgctggaacttttctccatcataggctttcaatagattattgatgtcaccaaactgtttcgttacctcctccggtgaagcaaatccttcaagtgacttgttaactacttcacacatcatgccggcgatattttccataaatgttttctgttctgccggcagaccgtccgttttcagattaaaatctgatactgtaaattttctaattggcataaaatttaaattttaagttatttattctcgaaacagctattcaaactcttgaaatcgagtaaagtgccattatcagcggctttaatcgttacttcatcgtccccattttccccgtcattcttttcttgagtgtcaacagacggctcattttttccggtggtatcttcagaagtattttgcagaatagcattcgaacgatatacttttccccaacagtggggacatcttacataattcataaggtcttgtagacccttttgagtaaattctttcttttctgatttgacagaatcaataagagaaattacttgggttctaatctctggagtgagcttctccatttcttcccttacaatgtcctgtgttatccatctctgataatcagcagcataatctaatacctgttgggcaaaggtatgctccgtttctgcatcataatcaaattgataaccacaatgaggacatgagacaacggcaccaccgttgaggctcttcagtaataaacttaattccatatcgtatccttttaaacgttcatcactatatccatgctgcaagaacgctttccggacgaaatcaacagcctcctttacctggtcagcagtagcagacttaatattcacaaggaacgtctggggattactcccccaacttgtcaatgttgaatattccatcatacgccattcaagcaccttacaaggatcgatagaatcccttttgatagcttttactccgatagagtgttctagggttcttccattctctgcaaacagcttataatcagccaacgtatcacgtccaatctgtttttcaagatttaactgaccgaccataaccaaattaccttctgtttccttaccactcaacggaacacctaacaactggtctgtacgatgattcaggaaccaacgcatccgaccaatattttctttcaatgtcttattgaatgagccgggcatagatatgtcattttgtgagtccttcacaccgataccgttcaccgcaacggtaacgatacccttctcatcaacatcatttgcctttgtcttgtactgaaggcttttgattttctcttccatctttttcatctccacttttagtgttaaaaactcgatttactttatccagttcctcatctgacatatcaaatttcaatttgtcaaacaagggattttctatcatactttcgcctatttgggcacgccagtcattgagtgttataagcccacatgagaattgttcacgacaacgtttatttatatttgtctttacgtcctcggattctttcaatccttcctgcaaacaatcaacatcagagaaatcacaatccaaataatatccccctccttcaagaccaaggaaagctgtaaaatccttgcagaattgtttggccataggaataacagttgaacaatatacgctcttttcagcagtagcctgattgctaaatgtggactggtcttttcgcggaacaagaacggcagggatgccgtatgcccctgcaatatttattgcatcagccaaagtctcttcaaacggctgtaactctgcaatagaaagattagtacgaacaaagtcaatgtctgcatctgaaataccataaggtacctggcccttccttacaccatacttctcaaaattttgcttcaaaagctgttccttttcatcgtcagtcaacgctattgaaccggtagcatcagttttcttacttacaataaagcccaatccaccccgctttacataaatcacatttctagcttcatatacagctattagatttgacattggcttattttgggaagcaagacgacttttggacttcaagaacatagcccctgaatagaactctgcacttccgtctctatcatgccatatttggtatggaggaatttccaaactaccattccaaccatactccaaacgatagctacgaataatatcttctgtttgggcaatgccaaacaatggcatattcccgtaaacaggttctacaatagtcttatcagaaggtagcacccaataattatcgcaatatctccatttttcagctgtagaaaagacatcaggcatagcggcacgaataaagctattccctgtacacaatttataaatatggtgctgataaatcaattctttccaacgcatcaaacaattaggacgactaagtatgccattcattcgtttattcgcccatactatactgtcatccttagttttcttcaattgaaaattagcacctgcaattcgcgatgcaatataatcgatcgggaaaaagacttcaggtatcgtactgaatagcgttagatagttactgcccgctacaataggactagtaaggtcctcaatgtatgcaactgaccatttttcagccttgccactttgagtatctatatccttattttcagatgaagtaactatttcaacttcacctttagtcttagatttctttccaaatagattatcaaaaaaaatattcattgggttcctttttgagcaaaactaagtaaaaaggaaaaccgttttccaaaacactaaaatcttgaaattacgaaaacataatgccaacaatataacattcttattttcaactacatataacacaattcaattcaaacctaattttacaacgaactgtactagcccactcaaaacagcactggcctcttttgtttcactatctttattatagtccatcaggttattcatgaaggcaacatattccgtatcagattctacttttgatgcagaaaaaagaatactatttttcacataatcagatgttgcagcaatacgcttatctacatccggaaactctttcattacacgaatctccttgtttgtactagaacggagttcccggataaaagggaaataagcatctgtacattcaattacacatgaatcagattcatgggacaaaatagaagaacgtatatcttctgttgaagtagtatccataaatacgacatcaacaacatgccatttatttccacatctaaacgcttgtataaggacaaatttcccattaacattcggcatcacatatagaatcttcttagtgtatttacactcggtatctggattgaagaaattaatagtgccattacaagcatacaagtttctttttcgccggttactaaactctatatactgctcactacacaaatccacaacgacatatcggaacgtatcagacaggtgcccgtgctcctcataagtctgcaaggtagttttattcttgaccttagttttaagaatggcaccgttagcatctttctgtacgctcatgtagtcctcaatagataccgaacatgattcgtcaatgtatatctctataccgggaacagtacaatcaaagatagcattgataaactcaccggtcatagtaacactcggattcttgttgcctaccttatcttcaatctcgaacccttctttctgcaatgtgtctatgaacaagtccatccaggaacgcttctcatcgtcaatgctgtttgccgctttcgttgatgcatcaccatgtacatataacctatcagaatattggatagatttcagaaactttgcaacaagtttggaggctttctttactgtattgtttggactttcggcgcatgtctcatggaactgccaaaccttgataccggtagtgaaatctacttgccagtacgacacactgatatatggcagtacgttattatctactgatatatgaataggcaggtccgggatatatttatgttcaccggaatgtttgccacggttgaacgaaccgaagaactcgctaccggtacgaataacaccccactctcccaatgcgtacacattgtaataatccggatcgtggactctatcatactcaaagtcggcaacacattgctcatcatagaaaccatacgtaccgtcaggactaccgaccacccaaaaattattcaaataggtagattggataataactgtattaggtgcctgttcctcgatttgcttagtacgaagattaagtatttgcctgggtgcattcttctttacggatttgaccttggtaagttctttcggcaactctttgccggcaatggtaaccgtcatcggtacatcatgccatttgtctttatcaatgaactctttctttatccagtggctttcactgatcggattaaaggtacaaataatctgctgccctttcttaccacgcaaacgcttacgtagctgcttgaaatccggatgctcgaactctgaccattcctctaactgaacacgcttatagttggagataccttttatcttttccggatcgtcaagaccggaaaaatctatcttcgcaccattaaccagacacttaatagtattctgttggaacttgaacaaatgggatatgccaagaccggccgcagcgactttataatcttcataaatggttttgagaatagaagctcctactttacgcatgacaagagtgttctcaccgtcctgtaatgtctgtatcagtattgtttgtgccacactgtacgacttaccggaagatgaacctccatagagaatgataaaacggatagtctcatcattcaagtacttcaatagatagaatccgttaggatttagcttcttataatttataaccatattgttctaaaagtaaggtttccccgtagggtgaataccggattttgcagttcaaattgttctattcttccgaattctcattatcttcaaatccgatacgaagttcaccgactttatttccgtctccacctttgatgttgacattcttatcggcttcccatccattccaggcaccaagaatccgggcggcttctgtcttgccgttgaactcataattaaccactcctctattattctgaatcttcttcaacgcattacgggcacgctttggaagttgggacggacttctcatctttgttttcccggtaacagggtctacataatgtaaatcatcgggatcagcgagtacaatatccattaataccttctcgaccgttttcctctctacttcagtctctttcgccctctgttgcttaatctcacttatccttgcactaaccttgctattggctaacaatctgctagcagcactccaaatcgtttcaggtttcatctttgacgcatcataagacatcctatatgcttcactagcattaccttctgtatcaacgtagtatttacagaatttctcttgcttgaatgttaatggtttctcttgctttcccatatcaattgttatttattcctacgagaaaaagaagctgctctctatcctttaaaagctcataggtggcaagcagtgtgctgccagttgttaatatgtcatcgtacactattatcttcttttcctttatcggacgaagaagaaagaattccggattcaatctatctttagttaggcactgaattgcattctcatagaatggtattttcaccgcccaacctattttcgtgcagatagaggttgcaaaatgaaagccctcgtagtgtctccgtcgcggtgtggtgactatacaccatccttcacatccccctacaatgaagcggtggagaaactcacacgctctctctgcaaagaatgatgcaagttcctccgactgtttaatttctgaaaagctggcaccagtcttggaacgggtgaactgggagatgtaatagatatcaccctttttatgaagtgacaccttttctctcaaatcacataaccgttcctgatgagaccagctcttacctttcaccgcttccggcttatcccagtcgtcaatacgacatatctttccctttcctttcatcaaagattttctttactccgtcctcgacagatgtgtaagacaaaggtactaaatagatatcccggttcaccgactgctccaaattgtcaaaatctcgttttttattaatcaactctatttcaatcggtttgtagtattttactaaagaagcaaaatacatagtagtcacaggttgaacgttacaaatattgataagttgccggttacaacccaccgaatagataagcccctcaatgacatcatctatgtaagtgaagcaccggatattctgaccacagttgtataatgacacgttttccttttccatcaggaaccagagaagagttctttttcgcggattaggtccatatacattatgcagccggcacccggtcgcagccttacaatagatagatgcatactgttcatcaaagtacttacttataccatagagacttgttgtgttctccgggttcgcggtcgatgaactggcatatactaattttacatggtattggttacatgcatcggctatgcacataaaggtatcaatattatctttccggatctgttccagatttccattgaatacacttgtttgtgctgccaggtgaaatacacagtcgatatcaccgtactttagaagttcacatacttttgaagcttcagtaccgttctttcgatcgatacctatcacttcaacatttcttttcgctaattcttggcagagggctttacctatgaagccttcactgccagttacaatcatttttctcatcatcacaaaaaaataaaggtgtatcggataaccaatacaccaaaggttcaacaattatataaatttcagttcttattatcataatctttccttacttttgcagtatgaataaagatagaaaaagagttctgataataggtaacggatttgacctttgtttaggcagaaagacttcatacaaggacttttgccaatctgaattttgtcccaaagactacccatctcctttaatcaaacatttaaatgacaaatggaacgataatttagatgcggtcaagtggtatgatttggagaatgaactaagttattattatactaaaattaagaataataatgggcatccattcgatttatataatagcacagaaagaaaaatattagaaatgatacatgcctatcatggtatttctgaatataatgatttaatacaaacaaatgctgagactgttaatagactattaaagataggcgtattatccaaacctggactttcttacataatctgtttatcacatgaagatgtgctaaattctccaattgaacgagataaaaaagccgtacagttgattaaagttgggttaatgcaatacctaataaaaattcaaaaagaagctattaatgaaaactccatagctgctacagtagcaagaacatttatcaaaagcaatgtaaatgatgaaattgtcatatactcttttaattatacaagttttggagcaatagctcccaactctagttttgctatggaatttaatgatgcagttaagtatgtacatggcttatgtttagacgggaatatcattttaggaacaagagatgaaaacatagacaaaaactatgattttatacagaaatcatttgattcccaatataatcccccagctatggtatatgatttaatggatgctgatgatattacaatatttgggcattcattaggcataaatgacagccaatattttaaagccttttttgaaagacaatcttcatccactaatccccaaaagaagaatattacaatattcactaaagacgcaaaatcggaaattgagataaaacgctcactacaagaaatgacaaattggaatttgacatctttatatggattgaataatctccaaataattaaaacagatgaatgtgtcaataatccaaccttattaagaaaatacatcaaaatgtatgttgacaatgaagaagatattgacagtataattcatatctaactattatgttactattattctgtactattgttatttactccatttactaccacagtataatcggtcatactctccatagctaacgacttgattcctttcatttacgaccaaattacacaagcaaatatcgtcctctgaattgatattgggatactcccaaaatgacaatttccctttagccggtatcggctctggaaataatataggattagctagtacccagttataaataggattttcataatagcctttactatcatctgttttctctgcccatttagaaggatgattgatagagcatccaattatttctacacttccaatgatagcagaattgacaatgccctctgcacatattatttttcgttgaaactcaataggcagactatcccattgagcttttgtaaatacactattgggatttctcatttctacaggtttcccacttgcatggattaacactctatgccctatgtatttccatggacacgcccaagtacggttctcaatatccttgataccatgcactattaaagaagcccatggttgttttattgttattgctttcattgataattttaaagtttgagttttctatataattattatctttgcagttgttagtaataactaactgagaaattctgaccataacatagtttgttaggtagaatctatctagtattaacctataaataatgtatatttatgaacaataagtattatttatttatcgctgcttgtaagggagctgctttacttggagagtttatctacctacatggaagaggagaattctctggtgctcgcggtgcgtacaattactgtaaacgcacaggagataaagcaggtgagttagctatatataattgtgtagttaaccgtaaagggcagaaggtttactgacctatggaccgggaaaattttcccggtcctttttattcttaatattatcataactttcgtattgttattaatcaaaatatccactacatttaaacccttttcgagggataaaatctttaaattcacagcttctaaacacccacttcttatcagcccatccggctaaatccttttgccattgaggaataatttgacgaggattatttaagtccctgtaaggctggcaatgcggcaagaaccgactgcctttattcttccaatgattgacacgctcaaacgattctttaaagtcactaagcaggatacaataaaagaagtattcgcctttgtaaccgtacttatcaatcaaagccgtagcacgctcacattctgctatttgtcccggtgtatcacaaccgaatcttatgcgcttcatccactttacttttgcaagcaaccgggctatatcatccgttaccagccgggcatctaatccttgattgaagtctacacgtactcccatggagacaatcttttcaatctgctgcaaaccgtagttggatgcaagtatgttgttatccatgagaatcacattttttcgcccagcagatacttccgcaatatccatgtaaggagtgatgtttccttctttggcaggtacaacacaccatttacaacgattaggacagccccttgtcaaaaagccataagccaaatttttatcaacattatacagatcgtaatcaggaatcattctatcaatttccggtagaagaaccttttttatgtcataccctgtaccgcctttctcaacttgatcggcattgatgtaatagccgtaatccggcgtaaagctaaatacttttgcaatgtaaaccttatcataagaacaaaggggattataccattctacattatcacctcttgccttgtgatagctacttatcttcatcaaagctagattaggataattgctatcgactgctagtattccgatattcatcacttatttggggctatttaaaaattctccttaatcctgaattaacagcatcggttttagcttcctctgatggatgaacataaatattcaaagtggtacctacatctgaatgaccaagaatagtagatacagttttgacatcaattttattctctataagagtcgtggcaaaagtgtgccttaatccatgatacttgatacagtggtctagttttaccttttcaagaataaatttctcataataattccgcaaggtccgaggttctgtatattgctcaccacaagtacacacataataatcgggattacacacagcagaaaacttcttcaccaaagggaaaatgttttttaagataggaatatacctatcagaatttgaagttttcgggggcccaatctcaatatgggtttttgctttattaaatgtaccatcctcgcctggcatatatatgcgttctaaggttttacaaatatgaatagtctttttatctaaatctatatccttccattgtaaggcacatacttcccctatacgcataccggaacatatcgttagcaaaattccaagattacgtggagatggattcgctaacacataatcgacgattttcttatattcagcaggagaataacgttccagcttttgagcagctatcttatttttacttggccataccatcttccatgtaatgttatgtacctcaaggtctaactcttcgtcagcaaaccgaattagcatttttagaactatcagaatatcattgcagtacttcacagataaccccgaattatccataagatcgttcatgaatggcacaataacctttttgctcaattccccaacttccatacatcctaacattggagaaagctttttcacgtatatctgctggtacgatgccagtgaactagtcttgacttgccttttctttacagaaatccaagccttatacacatcatccaatttcatatcttataaatttgttatttaaatcagtttcaattctcgcaaataaacatcaatctccttatccaattcggcacgtttggcttccagctcttttatttcatccataacagccttaatgtcaataggttcttcctcaaatacatctatgtatctcggtatgttaagattaaaatcattagccataacctcttgcaatgtggcacaatgactgtatttcttaatttccttacgctcttggaacgtctgtacaatcttgtctatttgttcatcactcaaagagttcttgtttttaagcttttcaaaatctttgcttgcatcaataaaaaggatgttctcatcttctttacgacatttctttattaccaagatacaagtaggaatactagtaccatagaatatattggccggtagcccaatgacagcatcaatgcagtttttatcttcaataagaaacctgcgaataacaccttcggcagcaccacgaaataaaactccatgaggaagaactatagccgcaatccctgttacatccagtttatggactatatccaagacaaaagcataatcagctttagatttaggggctaatttcccaacttcactaaatcgttcatcatccataaaagagacatctgcactccatttggcggaaaagggcggatttgctattactgtttccattttgatttatttttttgataatacactttcatatactcacgtatttcacttttgtgagctaattgatattttctatttttctctaatatcttttccttattaaccttatatctacgcttgtaactagccctctccaattctctataatgttcaatattggcatttcgcaattctttcctacgggcaagtaatttgtctctgttacgaatccgatatgccttattattcttcagtattttttcccgattttcaatataataacatgaattacaaattttcgtacttaaatagaatttgctttcaggtacatactccccacatttattacataataaaatattttcaggagtatttctaattgctaaatcagcttccccaaaacggttgtttctttttataaaggaaacctcatcgtaaatcagacgatcaaccaaatcccgccaattttcaatagaaaaacgttcgtcagctataacagaatgagagatatccatgtaattaatatcaatgccaggaaacaagaaattgattcttttcctagtgtattggtacagattctttataaaattatcgtcaatcataactaatcttttctataatggaaaaatcgaatggaatatctttcacgttcagcaagcgatattcactttttattgattttacaagtacatcaccatgatacacagttgcattaataccacgtatcgataaattaagcaagagtaacggaatagacctatcagacaactcccagcattcaacggggtgttcagacggtttgaaatcagttcctaaagttttaactctatgccaccagttagaaataataagggaaccattcccggcagtaggttcgtaaatcacccctttggaaacccctgtcaatcttgatagtagtattcctactacattaggagtaaaatcctgcttgttttggtttctttgagccaattcaccctcatatatatcttgaaaccaatctcttgaaagatcatgagtattgagttgtaataactctcgatatatatgatgcaatctttcgtcattatcaaagattattttaaaaatcgcattaggaagtgataatatatcctctatttgaaacaacttctttaattctacttcactcatatttactctgtatttgaatattaatctcttgcttcagccattcttcggcctttagccgttgccgaatagatattcggcttaccaccgctgaaacatttagtttttatccattcatatctttcagcttcccggagatagaataatattccgtattcagatgtatttttcaaccaatctaatttcttgatttgctcaaatgtcataggaccgccatatacaagcaatgatgttaacatctgagctctttctttcaatgaatattcactcataatcaatacgggtttatgcaattctccatagcgttccgccactcatcctccgttatcgggatcatgtcatcataaaggttgaaccctatgatgtagcacccgctcttatagttattctcgatacattcataatggaaagtccgggatttcttgtcaaacatgcttttaggagtcagccggaacaccttccttccatgtctgtaccacctgtggggtaccttcttgctgaaatgctttacaaaaacgctcatttctttttatgattttaattaatatttatccatttacatatcatttacatactgtaaatcaatcatctcattgttttataaataactattgcctatctttgttgtctaattttaaaaataaaaatatgttagtaattaaatctacaaaagaaggctatgagcttaatcaagggatttcactgagattgtttgagccatccggaaacactgttgtaaaagtagtatgtgaaactccttattacggggaaccgaaccatttagaaaacgctatttgtaatcacataaatagcttaatgcctgatggctatacagtaaaaaccaatcatgtgactcttgaatcaagtactggaagtgatatgaaaggcaaatatgtcgaatctctaatgtttcagatttatatctaatctcagtaaagtcctgactacctattcaggactttttcatttatcgctttactcatttctatcttcggtattgagagttaatacttcttcccgtgcatcttttcacgaagttcgttatacttcattttctgctcgatgtgccaaagcaggtctatatctaagtgcttggcaagcccgaagattgatagtatcatatcattcacggttgtaggaaaatcaaatattccgtcatacctaacaggaagtgtagagatggaatagattgattcggtgaaagtttcgtctttacaagcttctgccatatcttcaatacagtcatcaatatctccgttggcaagttcaaggcttattcctcgaagtcctgcaaggtcaagcaagcggattacagcatcgactaactcttcctcaattgagccttttatagtttcattgtatgcgacttcgtaaccacgctctttgggaatgtcagaatccaatccttgacaaatgcggctgttagcaatcttcttattataccgatcaacattagcacgccttccttttctatctgcttccacagcttccatcaattcagaaatcacaaggcaaagaaaatgattgttacttagctcttgatcgtgaaacccatgttcacaagctgttttatatgctttgtctcttaattcatttaaattcattttactcatccttgtaatgcttaaatatatctatccaattccttttctaataattctccatctatttcaggaaacagcttcagaactaaatccaatgatttgcaataattgttattgtattcttcagtatccattaatcgaagtaccatagaacaaaagatactttttgtgtcttttaattcgcctttcatcaacaattttgatagttcgataatttgaccagtaggattatgaaaacttccgtttatatattgaaaaattagtcttccttcaaattggcatatttcacaatctagttcacaatcaatgtactctatcttaccatttatgaattcacaataaacacattcactattagaagcaaataaaactgcaaaatcatagatatcatcactattacctacaattattgaagtagattcaagagtttccgaaacaccattattccactttgcatcttcaataagttccctcacatattcttgaactcttgtaatgttctgctctattaaatcttttttactcataatttcaattcaattaagttcgattatttttttgcaatattctcccaaaaagcaacgccttcaggagtaccattaaaagggaatgagatagctagaaatcgatgaaaacagcaatcaacatctaacaaattgttcacccgctcttcatttgtcattgagaagtcaggacactcaatattaaatgtatcatttgctctttctgtgttatatttccattgattgaaaatacctagtctttctaatttttctattttttcattcctcttcatgttgattgacttttaatgctttacgtctataaaggtaatcgttattgacaagtttagcaaacagaaacttcgccattttaacgccattttaatcagtttttttcttcaacaattcacgtctaaatctttcctctaaatcaaaaatggtttctccactattacgacgatagggcctatcggtatttaactgaagttctttcagctttttccaataccatggaagatacaaatacatattcttcaactccttcaagttcttatttccacaacaccagcaactcacacgatcaagtagctcatatagccttactccatcctcatgccaaacaaaaccttttgtgtaacaatactggagtgcatctgcttcagtaataccccaatcacgaagtggtaaaacccgattaggtcgattttccttttcaaagcgatgggtctcatcggcagcaataccgacataatcaattccgtcttttgtgtgagctttcaatgcacgaagtttttcactcgttccccaccggcatgttcccccacaccaactatatccctttttatgaataatattggtccctcttttcttaaccggcctttcaaacattgtccaaagaaaaggttgctccggatgcagttcggtatatttaatgccaagttttttaagaattggaagaacagcatcacgagtgttatagattgcctgaaattccatacctgtatcatagaaaacgacttcatccaactgatatcctttttctattagcatgaaaagcattgccaaggaatcctttccaaagctgactgaagcataatatttcatacaaaaaatttaatagacaaatcactttttcttctttgccctctgattattaatctgtgacatacacatacggcaccaggaagtcaacaaatgatattccttaccttttctcaccactatacgattgtagaaccggttcaagtagaagtaatttccgcaatgggtacatcttttcatttcacgtcctgaatcatctataatccgattacgcggcttacgatgaattagagtacaacttttacacttctcatcagtttcgcggtgccgccggcaatgtgataaggattttgctccacatttagcaaacaccttacaatctctacgaggtattgattgacacacattcatggcttccttgcattcaagaatttatttactacacgagaaagtacatcctcattctccggcatcagccattcttttgcaacgttccaagcaatactcatagcaggattgaagttatccttcctgacagtgtgatgagacaaacgtccttcagtgggcttcaaacccttatcatgtaagatacacagtccattctcgaaaaaagcacaatactccttaccagcaacgggctgaatcatcggaatagcaatattaataacccctaagaatataccagcagcccagttcgtcagcgctaacctgtcggcataacctgcatcaataattcgttcaatatcatcaggagtacctaaacatggcgtatgacattgttgtttacaaacactgcatgagcattgtacaggtacacgacctgaagccctcattaccctttgtaatgagatttctttagataattctctcatagtaaattatttgagatactacagattagtaaacatcgccccacagttttattgcaagttcgtatttcttttgcaactcattcacttctttttttgcataagtgagagtgtaagagtggctacgtggatatttgccggacttcaatccttcatgatattcttttgcttgttccaacttatgttcgtagaaatctatactttccggcatggacaagtttatcgtattagcccttttttcccaatacttcgcaactctttcatgttcggcagccttatcactaagctcaacgcttttccccatgttattccaggcatcatctatcattttgcgatgtcctcgttcgctatggtgtccaactttgataggctcacccaaagaaaggaaatcacgatgcttatttgatttctgaaaatactcattacttttttgtacagccgatgacgcccattcatgcctgcgttccgctctttgcttagcccattcttgaacattaaagccgtcagctctaacgatggaataatagtaaaacccatctttttcgaagattaggttaaatactatactttcgttctccttaccatacttggtggtaacttcaatagtttcacctttttcgtgcttctcatcacactttgccaaaaatacatttggcgcaaatttgtaatacgtgttcatttttttaattaaattggtttgacttatatgaaatatgagaaaccacagctacttagccgtggtttcatcattaaataactttggttgactgggttgaaccaaatcatcgaataaaccaggaacacgaggttgtaacgccttgtattcttcctgaaagaattcttctttggttctcccatgttttttaccctttcgtgtatgtacatcgaaagtgtaatctgggataggaatagggtaacgcctgacatcatttatccacttttctatatcaatatcctttctatcatagatgaagttttgcaaatgatccgcatcacgattctttctacattcacaaaggagaataacagctttactcacaaatatcctccctttgggttcagtagcagtcttgtttaccagctcatgcccctgccacaatgcttctatctctttagtaatgattccatagcaatcttcagcactaatggtaaacagacgcttccacacatagtcgcggtacccactcgcccaaagttccaatgcaaaaaagccggctaccccggtgtcggctcgcctaatggctttctgcattgcagaactcacctcaaagaaatcatatccgcaaactgttcttataatcataattctaatttaatggtttgacttttagtttattacatcagtaaaattagctaaaaaaggcgaatatgacaaacagaatggacgccatttaaacgccttttttacagactattagaatttgaatttgcatgatatattatattgaacgagctgctttgttttgtctttcccattagtggttgcactctttagcaaaatactatcaccaaaattctttttgataaagaggatagatttacgttcctcttcctgattccttatagaagcaagcccaccagcgtttacaaaagtgttcttttgctcaaaattataccgcaaatcggttaaaactttacgttctttgtacttcatgtaacaagaaatccaaaaatcttccttcaaacgtatttcctcattccaccaagtgtttttgttatagattactccataactgcaaccggttatcattttcgaaagagaaagaaaagcggattcatcatacattaccggcgatatccgagcggtgaagccaaacagatgtacatccatcatactggccatctcaaataatgactgaatgatattggttatcttatctttatcctttatccggctaggttctcctttttccacataaataggtttgcaggcatggacatcatcatcaagcatgaaaagttctccaaaatgctttgccatccaattacgtttcgggatgaggcccataacgtcgtcaggatgagtaacaatttcacattccgggttaaattgctgatataagtcagcttgactttcagcaacgcaaatgataggatcgttcaccaactttttagcgaacacccggtcatggcgtttatgacttggtattactatcttgcagggcatggcgaacgtcttttatatcaattacattggatttacttattttcccggtcttgtacgacttcatgtgctgcatgtccagcctttcacgaagccagttgctatctacctcattacttgaggtgatgataaacaactcatgtttttcgtcatactttggaatgagaggataaatggctgtatcatccgtgatggcatcgaagcgctctttaaattcatcctctttcctctccggggcaaattcgatgccccagtcttggagttccgccttattccactcgttttccataacgtccaaatcattctcaccaaaattgacattatctttagtggcatattccctcaacttcttaacgggggtatcaggtgccagaattttacaaggcagttctttataacctaactccttgcaagctcgcaaacgtaaattaccacaaacaacaatatatctgccatcattgtagggaaaaactataagttctcgaagctcaagcatctctggtgaatcctgaatgcttttcttcatcgcttcaaagcggtaatcacgaaaaaaacgtggatttttcggcaatcccgtgagctgccccttattaaaatcaagtaggcagacttgaataatctctgtcataactaactatattaaaatcaacaacacaaaatcaacaacacaaacagtcagtaacaacacctaatcattttttctatcatcgaactctatcttatctttgataagctgttcaatgtcctcacaaccaaatctttttaaataggcaacaaggtaaattatcatctcggctgccaattcttcatcttccgaatatttaggaagattatcactcctatatttagaagcaatatcgaattttctccaaacggcttcaattcttatgctaaacgcttttcttgagctatgctcattcatcttaaagcgcttcctcatgatattcaagcatctctgggcaaacctattcaatgttatcatatcgatcgggttaaattgttagactatgaataatctcacacgattctattaggttggtctctgatgcgaaaccaatgaacatattctttatctatcagcatactattatttattttgaggggtctgttgtatctaaatatttcctgtactctaattctgtcttagcaagattgattacggtattaaccccttggaaaacttgttttgcttggctcactttactagggtcttctttcacatccttaatttgttgaagaaccaaattcctcaaatcttgtaaaatggtagggttcactgtagacaccttattcaaccgttcattagccaacacgacaactgtgtttgttattggccggaaacgattcaatttggaagccaaatcaaacatactaaataccaatactttgccattattcaagtatatctcaacttcggtaccatcatcaccggtaccgtcacagtaattgagaattacaacttcttcattctgataaaggaatggtttattaaccatttctttcaatctatctattgctccatcagtcatgattcattcttttttgttgctttattaatttgtctattcaaagctccttttagcttgattaggtactgaacatcttccggatatcgggcatacaaagaattctctttttttaattgttcagaacgactaatcatgtaaaggttctcaatggaaacgttttgcctgttgccatccttaaactgaatattataaccaggggggatttctccattatgctcaatccatacaagccgatgtttaagttcaaagacattcggttcggcagttttcacttcaatgtaaccgtcacgagttatgcgttcataaccgactggtttatgatttttggggatatgtcctttcttaaatcgagtagctttcgtttttgctaattgttcctctgacatatattccgtttgcttacgtcccttgttcatcggttggtggcctttgggaaagaagcttttagaagcgcattgaaatttaaaatctttagatttaaagagccgtaatttaaatgcaattccatttacagcagaataagtggtacctaatatctgtgctatttcctcattagtatgattgggatacaactttttcaatttatcaagtctctcactattccaaaacgagattctcggagagcgcctaagttttcgaatcaaggcctttgttttaacagcactaagtgttttatcaagacgcctagcaagttcttttaaatcagcagtcgggtactcactgtcaagtatagcaagttgttcgccagtccacgttttcataagtgcgtcaataaagagaggaaaccactaggcttcctctgtgttatcgttatttagctctttcagtctttctttgagcttcttttctttcttatcatatgaatccgcaagtttcttagagagcgctttgaaatcatccggatattgttctgcaaaaaggattttctgacacttttgcaaataggagtagaaattcacattattcgatgataagcattcagcaataaaggctctataccattggtgtcggtcagcttggttgttcttgacataatttacaaaatcactctcaccattccattttttcaaattcagtttttcaagataagtactgctacaaccgctaagaaccagcacatcaaaaacaagttgttcattttcagagaattcttttgttctctgataatatgttttctcttgcgcccacttgcgcatttcttcagcagacttctccttgactatatccttcgctctttttaattgggcgtttattttttccctttctatctcttttagatcggcaacggcggaagtagaggaagccgtttcttttctaacataatagaaactaacgttaaattcgggagaataatgtccaaaaaatgaaagacaacgataaacttctccatcttcaagcattttcaaaatgcgttcatcatcttctgaataccagcacttacatctaaagatttcatcaggatcaactatttcaaatccaagttgtttaacagcttccaaagttttttcatagaaaacctttctatcttctccccaatatgtatcgggacgtctagcgataattactgtttttccaaatgaaagaggttcgccaactttaacaagatgttcatattctagttgaattttccgcgtcacataagcaatctgttttttctcatagcaggcagcattgatacatctagtatccttactattcatttcatagaacaaacaaccatgattacacgtattattctcacattgagaacatgatttaatatcagtattttcccaattatcggaatcatctttaatccaaggtgcgttaccaagctccatgaaagaattactcacaaattctcgaatcatagcagtagtacattgttcttcctcctcctcatgaaactctttttgagtatcttcatccaatttagaaagaatcatagcaccggacaacggtatatctccatttcttacccgctcttttagttcaggaataagagaattcaatttaatacggtcaaaaacaaaccgggtagactttcctattttaagagcgatatcttccaaagttcgtcctttttcagccaactgcgcaaaggcaaaagcttcttcgatgggatcaacatcttttctttgaagattctcggtaatcatcgcttcaaaagcctcatcatctgtcatttctctgacaatgcaggatattgtctgaaatttttccgacttttttcgatgggctttgatttttgcaacattcgcttcatcttcctttgctttcaaaagtgacacagcccggaaacgacgctcaccgcaaacaatttcgtatgtgtaaggtaatggggtaacatctccggtttctaggttagtcatctcctcggatttagcaactctgacagtgataggttgcaataaaccttgcttttcaatgttgcttgcaagctcttcaagagctgcttcatcaaaagtctttctcggattcaaaggagaaggactgataaggtcaattctaatgttttgtacttccataatttaattatattggtttgacttttaattcattacatcagtaaagttatcgtaaaatgacaagttatgcaaacagaaacttcgccattttaacgccattttcatgcgggcttattacgtatttgaatgaagccacgtttttccgtttcccgaagcaattccatatcttcctcacggatataacaatccgtttcaccattaacagttgtgtgattaggaataccaaaacgctcccgtattcttcttttcacttcaggaatatcttcaagtttgatatgcctagtgttccagtaaattgtcaccttctgcttcttgtttgccattttctcttttgtttagataagagattatttcatttgagagacttaacgctttagcagcttcttcatctccttgctcaactctaagtttgagttcgttccggtattcttcatacgacaagccacttgtatagctcacttcctccgacaaattctctttataaaaattccatgactgattatcagcaacagcacaacgttctttattgtattcacgaagccaactcatgatgacctgaccatcaattctattatagatattgccatatttcattttcattgcgttcttgaaacacagtttaaaatcatcagttttcatatatggatattcttcaatgattaaatctactgtagtagcgacttgtgtagccgacattggattaccgacattgaaaaactccaaggcatcagctatcaatatgaccaacactgctctggcttgcggctcaccaaactttcttataatagtgccaatagaaggttcatcactttgaaatacatcttcaaccttcttggggcatagagctttgcaatagtttttcggcgaggtccgtaagactgctaaccgattctcttcttgtggccgcagtatcagttcgttttccattgtaatttccttctaaaattttagtaaaattcgcagacttgaatatccagtcaaaagtgcacctccaatttttatcgttttgtccaagcaagaaaggactgtctaaaaccaattggaacacatcgaatacagcttgcttcccgtattgtgcgacacgtgctttaatagctttctttcgttttgcatctatggactttatagcaggaagtttacctttaaacgtggaattaaaataatccattagcccaccccaatcaatcttttcctcggggaacaaagaaagctcgtctttctttgattctcctttaggagaagtttctttcttttttaaatgagaatcattatcatctacataatcattatcatattcattatcattatcgggttttgtgggttcttttgggtttccaaataacccagtgggttttgtgggttctttgggttcttttgggttttcacttttcggacgtccccccttagaaccattgctcttattcctttccacaatagacatatacttttcagtatccctgtctatatctatctttataaagttgaaagcaatatttgccataggtttcaacccccgaagatttcccgttgtcgcatactcaattatgctttcgtaaatctccagcctgacatcatccggcaaatccttgattgcttctctccaccctttataaaagatgaatgaatttctttccatattttaagggattatactccgattagtaataaaactcacagaccttttgcttccttcagttttttcgcttcttccttgtaatgagtaatcagcttttctaattgaaagtcactaaattgcttagtaacatttttcttggcttccaggatcagcacatttcgttcaccatacttggcaactagacgtctgcgataatcctgaatatttccttccatgaagcggttacaatgtgaacattgagcattgcaattcatttcatcaaagcgagtactcatgtgttggcggttgatgtaatgaccgcaatctgctttattgaaaggctttattttaccacatgaaatacactgaaaatatccattaggcatcgtatcacgataacggatgaataaactaaatattctgtctagtttatcgacaagatcaggtttcttcttgaccttaacaccttctacctcgaaaagaggctttttcttttctttcttcttgtaatttctccacatgataattaaaatactacattggttaattgacggccacgactcattatacaccattttcccttttcaggctgttctatgcgtaactcttcaacacgcccaaaacgccggaaattcccactcaaatcaacaacccaaccctctttaccttggcagggacgaataacacgaccgaccatttgataatagagggaaagggatttggttggacgtgcaagaacaatcgtatcaagctccgggtaatcgaatccggttgtaagtactccgacattagcaacaacttttattcttccatctttaaaacctttcagaattcgtgccctttcttcctttggagtagaaccgctaacgatcgcacaattaggaatttcggaagccagtttttcagcttcacgaataaacctcgtgaatattaaaatacctttgcgtggtatgcccgatttggggttcaacagacgttttgtccatccaactatatctttgtatatgtccacacgttcaaactcttgcagaagacttttttcatcgtaatctgcaccagtagaattagtcctgactctacttaaatccaactttgtaatatcatagtatttcaaacttgcgagaaatcctttagcaagtagttcactcacctgacagtgataaataacatcagtgaaaacctttggccgggtacgagttataaatttaagcatagcaccacctcttcctgaacataatctgtaaggagtcgctgtcagcccaataactttcctttgctcatcttcaaagaattccttatacattcctttctccggattcactaaatgacattcatcaatcagaacgtgcttgaaatgtttgaagaaactcatgtgtttcatcacactaccaatcatagcaaacgtaatacgattgatatcctttcttccggcagaagctgaataaactccacaatcgaatatgccgtatgattgaagtttcgcaaaattttgttcgagtatttccttgctaggctggaacactatcagcggcccgtctatccgtgcagctatattggcaatgacaagggacttcccggcaccagtgggaagaactatcacgtagtttttcttttccttggatttaaaaacgctgaccgctgcatcactagcacttttttggtagtctcttaactggtatgtcataatttgatgtgatatttatgaactttcgaatgacagtcaccacaaagggtaacgagacaatcaagatgttcaagctcatgaccaacgattgattttccgttaaccctgtatgttttgtggtgaatctctaaattaaagtctttaccgcacatctggcatttatgtccgtccctaatacgaactttacgcttggcttcttcccaatctggattattcacaagccgcttcacatagttggacttcctgccttttttgtgctgcaatctactcatcgtcttccggttcttcttcaggaagtttatcagacaggtcttcttcgaacttgtccccataatcttctgtatcatcaataggacgttctacttcaggatattcaataccaaacaaatcaagcatcgcttttctgtttcgatcttcctgtgcccaaagagaacgtttgtcccaatcaggaattttttcagctttcacaagcttaaactcaccgttcacccatgaataatacaggaaatatccatcaagagcaaaccggatcgtattcttacttgaaagatgatactccctcgtcccctttttgacctcggcagccaggtctttaatttcagtcttaatagaagctaacctgtcttgtgcatcactcttaattttctttgcacgttcaatggcttccaacagttcacgttcgcgtttggggacctcattctcttgcttgatgcaatactcttcacgaatttcggaaatctcaaattcatccagtaaacgttgtgtcacctcactttcagggaatgtagcattgaaatgctcattcaccaactttatcaattcatctacattcgtagaaccctgaaataaaacagggggaaatttttcccgaatagaatcgggaactacaaactcgattgtctcgggttcgtagtttctcaaatttgcaatcataaattataaaaggattaattagtaccggttttggtactcatgaataaaatctaagtaatgctggtcttcaggcaatggaagtgtaataccaaactcggtggccgcatctattttcacgctttccatgaaattatgcatctctaaagtattaagtttacttgttcctcgcacaatagtttccaccttaccattcacatgaacctgtttcacaagaaacttcttacaatacaagtcatgtatatcctgaactccagcagcagtgctccaatactcttcacctgtgtattcacgcaaacaggcaccaatacactgaaaccatttccacatgagagcattttgatttaatgttctcggctgtgtttttttcttaatggttacagtgtattctccattacgaagtgtgctgcacatgaactcgaaagacttatccatttggattttgccatctttcttcgtcaatgttgcttccataacctatcagaatggcaaatcgtccttggtcggtggtggcggtggcgggcactcattcaccgcacttcgagtctgattattggtgtgttctggaagaggtggcggtggtggcgcttgttgaggcttaacagaaagcatctccatattatcaacaaaaagttctgtaatataccgtttaattcctctgctatcatcataactccgagttcttatctttccttccagatacaacttgtctcccttatggacatacttctcaacaacatcggcaagaccacgccaaacaacaatattatgccattcagttctttcaggaacctgtgttccattggcaagggtataacctttttcagtggtggcaaaggagaaagtggccactttagaaccagcttccaaaattctaatatcggggtctttgccaacatgcccgataagcatcaatttgtttaaactcatgatttatcctcccttattgttacacggatactatcagctttaggaactgttttgatatacttagaatataattccggatagtcagcctgaaactttttagtatcaaaattgtcacttgtagaagcgggtgtataactaactcgcaatcttccggcatcccatgacttgacaccattctcacgcatagcagttttcagttttgccttataatctttctgaatcttggttagatctgcaagttcttcctcaattccgattatagtatttacaagttgcattggaataagtaacttgtcatcatcaggggcaggaacaggaagaatggatagatattgctcacccttcttctcgcattccattaatttcttgacttctttatcaggcttacgaggaatttcaaccaattcatgtttatcaccacgtacccaaatgccgaacaatttatcaactttgagtaatggattttgtagttcaaacagataagcataaattgacaactgccaactcaaatactcttcgtcaagatgcagcgtagttttgatgtcaccaagacagattctaccggctttctcccaaacacaatctatattcgatgcaaagtattcgttatcagacaccgtgtactcattagcaaaagccttatatccagctttcgttcgctctttcaaataattctctgcttcaatactttcaggcggtaagcctgttgcatcaacaaactggcattgagcatgaataaggctccccttctcagcagctctcttcaacacaaaatctgggacatctttatatttgtcagggaacaactgccggctaatcataccggttataccttgcaactgtttttcaccaagcatataagtgtggttttcctcattgaaaaccacactggatttcactaattctatcattattatcaatttttagggggatatgttttctgcatgtcaatagttatgtttctgaactccttattattgtgaagttcaggatgttcagcccaaactctttcaagctcttcgcggcttttaacaccagtcatttgtttaattgcacgatccaggtctacaccagtatatactttgcccgaagcgtttgaagcagaaacattgggagcatatactttttcctttgtattaccataagcaaaacgaacacggtttttattgtccacaataacaagtagaataatctccttttgctcgttatagccaatctctttcacactgaatttggtatatagagcaggagaacctgttttgctctgatatacttcatttttctcaagtggaatccaaatgaaaggacccgtataaagttcacgcccaattccccagttaaatcctgcacgtttaaaagcgtccgaagcctgccctttctctttttctgtgctggattctgttccaacatcctgtttactcacccattccttcttttcattatcccaaatggataacgtacagaatagattcccattaacgacatcatggtgccgtttccagttcatttctccgaacacttcatcaagtattctcatgtctactcgagcatccttgtataatagcaaggagcagcccgaaccgtccggtttcatagtaccaaccctacattcaatttcagaagctagaagcggtctgatagaatttttcttcttctcttcattctgaaccgttgatacagtgttttttctcgctgtcataattctaatttaatggtttgacttttagtttattacatcagtaaaggtaatcgttattgacaagtttaacaaacagaaacttcgccattttaacgccattttcaagtagttaaaaactgcctgtacggtattgtacaggcagaaaaataagaaaatgaataatccaatgtaccttatggaacggctacgcttgaagggtgtacggctccctgatttatacataatgtaaatgctagtggacggaaccggagtcgaaccggtctcacggaatattggtgcacctcaccgcagtttcagccaacgatatacatatccgcccgattaattaaaaaggtgcactatcttcacagaccatacaccccaatcacaaacacaaaacaaaactcatgaactactataatttaataggatcagaaatgtgaatggcgtgggactcgaacccacatcacgcatacctgcgtatgctgccaattacaccagccatccgttttaagtgaactattctcacgaaccattcacctagaacacaaacacaaaataaaacacgacattaactattaaatagcactctcacgagcttttgtggggcagtttaggagtcgaacctaaataattgcaaatgcaatacataaagcacttcgtacgctttctttatgctctctttaccattgagaatacctccccttgttgccacaccaacccgtgatgtggctcaattttaaatttagaaatttgaagaaaatcaattcactctcacgagcttcttgtttccggatagccgttcaaagcacaccggaatagtatagaacaattaaaactcaaataacagggactttaaccctacagcgtccttttcgctggcaacattagttaaacataaaaagaaaaattctctgtgaaggaacccggactcgaaccgggatgatagattacctatgtatgactttcttcaatctatctgcatacttgcgtctaccaattccgccattccttcaattcgtagccagacgattctggctacattgattgattgttattgatacaaacataattttccccctcacgggttacttaactctgattgagttgagccgggaaacggattcgaaccgctgacctcatgtaacgacttctagtacaccattggaaacatagttaacgccctataattttctgtttttctcccaagaatgtacgccatgcgctctaaccacctgagctacctcggcaagtgcccggcgaaccgggctaattggcaaatactaaaattaagcaatgttgaccttcacaggctatttttatattcttctcctttcctcatagtcgaatctcacagccaataatgcaacagttataatgaatatgagatatgaccaggcgatatcacttctcgtagcttcgattcccccacctatatacatagctactaatatggcaactactgtaaaaatgttatgaatgaattttatttttttcatctcttccgttttttaggtttaactttctttctcgaacatcggcaatgcagtaatacttgagcagcattacaatgccatttgccattttgaacatttacaggcttatcactttcaatcttacctgcttcaatgagactaatcaactttttctcgccaccgacatagtatgctgacttatcttttccgaatatctctgtcgaaaacaatcggagaatgttatccagcaatatttcagccatttcacctctaatcatctcaataagcaaataagttaagtagttctagtaaccttaaatattccatcctgaacataagatttagtagtccaggacatgccttcccctttttctttatataatctctgatttaaagtgaaaaccacagacgttttttgagtaatgggaaacacttcttcatcaccgacatccatgtttcgcaaaacattgattatactgcgtttctgaatttctttttccatacaattaaattttaaattaaacttgaagcaatgagcggattcgaaccgccaacctctgcttgtggtgctcttccgttaagctaagagtatttcttgagagactcgaactctcaaccatccaccacacacagcgctctaaccaattgagctacatcgctcttatatgttattcattttaattctatctatatacttaccgaaatcctctgctattcggttgcagggtaatttttgaacctcgcttttattgctaaccacggctctacaccggtgtaccaaaccaccgtcttactacagcctaactacctaccctcacgggcttcatattcctgctacgtaagccatatatgttccacaatgtcaaagaactcttctctgttgttcccagtctcccttcaagggcaggctcaaagaccggactgggtgccggataaccggcagtttggtttgactttagtgagggttagagaatactttggttgttcttcaaaactatgtccattaagtttcgttgcgattcaataaatttcttcaaatcatcacattgggaaactttctctctataaaatccacgttctgattctaaatctcgtttgagtttttcattttcacctctcaaagagctgatcaacgcgtctcgttcttcaatcacagcttcatatttgtctcgctgtatttctagttcggttcttttatccattgttgtataatttgattaatctccgacgtaatgtgcaccgtaatgagtactatttgggttgtagtaagcggaagcgggaatattaaggttattatattccttgctaggtgtagctttggcagtcttgctcatagcttcatgtctttcagctaaaaatttatcagttcttgatttcactgcttccggtgagaaactttcttggagttttgcaaagctccatgcagattttaaacactctgaaaatgtttttccacccttcttgtaattgcggtgtgcagacttcattatttgtgataaattgtagctcataatcgttattttttaattggttttatcaatcattttttgtatgtttgtatgattgattgatttatgatgcaaatgtaatccaaatatggataatttcaaatccaaaaacctattttattatccatatttggatatattaactttatagtagtttttatgattaatagaattaaagaagtcatagccctttcagggctatctgatagggcatttgccattaaatgtggtattaaacaaaacacattgagtagacaattaggaggggtaagtgaggttagcgcctcaactattaatgcaatattggataactacgaagaaatatccgcagaatggctgttaagaggaaaaggttctatgcttcttcaaaaagaagaaacagaaccaggaatggataaattgaaaagtatagtatataccatcgccaatttacaagatgagattaatgaaaagacgatgctcactcaacgtcttttggaagaaaatcaaaaactgaaaggtgaattagctatgttaaagaatgaaagaaatataggataaaccaacaacacagaaatgaaaaaaatactattactaattttagctacaatgccattgttctgctttgctcaaaaagtagacacaaaaatagacgattttacaggtgagaaagtagttacaacatcgtgggaaaagatttactcgggtggtgcaacaggtaagaatcaaacacgaataagattcagacacgaaggcggtgtagatttgatagagtttcgtgtcttcacagactgtgctacttcgtgtaataaaggacaagaaatgctcctcaaaacgaacgacggaattatcaaagtaaaaaatgtagaatatacgctagcaaaaccaggggattggaccccaaatggcattaatagcaaactaggaatttatattgtatgtctagggagtgatttagaaaagctctcaaacgaaacagtaactaaaatgcggctaacatttagtgatggatatagagatatagctttgaaggaaaaggattcttctaagctacaagagttatacaatcaattcaataaagccaaataacaaccttgagtatcgttttatgaaaaagatattaatcgcattaatgcttattataccactttttgcaaatgcacaaaaagataataatttagcattcaaagattcgttgaatatatataaggatacttcatccgaatatcactcaaaattagattcactatattctagtttcgaggaaaaatataaaaatcaacaagttactaatattggtggcattccttttgggatttctagagaagaagcattacccatattaagaaacaagtatggagaagaaatgtataatcctaagaaaaaaaacatattgtcttttaataatataaagtatgctggtgtggattttaatactgtgcattttcttttccaatcagacggaattaatagttattttaatacttgcatatttgttttaaacgcagatacagaaaaagaagcaattgacaaacaaaaaaaaatgagcgatattttgtctaaaaaatatgaattatcttgcgttaaagatgccaatggacttgattcatacggtggtggcgtatccccattatgggatggacattggagttcgttgttaaaagaagaatatctcacagcgatccatacagatataatcaagtacgatgaagagctagcaaaagacactggaatcaaatatgctactcgtataatctatggtccttacaattatattaaagaagagttttagttcctaattatattatcagcaaacaacaactattataaaattacaatatgcgcccaattagaactgtacccccaaaagatgaaagagaatatcctttagttataacagctgaagaaaaggataaagtattaaattatattttggttgtagcaaacgggaaaagaacagctaaactaaattataaagatataccagaccttaggatcagtaaagaacaatatgaaatagttttagaggagttcaaaaataggagatttattgactataatatgtacgatattgaagatattgaatttgatttagagcctggaatatacaattttatagaaagaggaggatttacagttgaaagagacttatacattataaattttgatgttcttgagttgcaattaaaacgattggaaaaagaattaagcccgaccactgcaataaaggtcaataatgttgtcgcaaatgctaaaaacgttacagaattagtgatcgggctcaaagcaataatagaaatgctaggaacctaactctttttatcaggacttccatcaggatttaataacaaaaattgcaatatagatgcagcatgaagaagtttagatgcatacaaggtagaatcagcatgtggatcatagcgataccttctcgctttgaattttttaaactcaacaaagccactagccatttcacctgctaaaattcttaaacttgaaattgtatcccgtacatcattgtcataagacatttctatccttctacgaacagattcacttgttctggaatagcaatcgggataaaaggctgttgcattatcttctttagaagattgttttttacttatccttcttaggacattttttaataacgatttcataaacgcactattttagtttgacaatgcgcaaatataatatttaaagtaatataaaatatgaaatatagaaatcttgatagtacataaaacatcaaatggtcgaattatggtcgaaccataaaaaaaagcaggactatataattgatatacagaatatacaactagatttccaaaaatgtgtctagtttagtttttgtgttaatagctccctcgtcagcggacgaactagggagctatttttataattgatatacaacaaactattaaattcaaatcgagccctttctttcttaatgagtatttatcattgaaagttaaaacgtcacttttgacgttatttacattgccgcaaccgtactgcggcaatacatactaattaaatagaatttaaacatggctaatctatttattttattaccagtcatattatatcaaaagaaaacgaaaaaaagtggcttgatcatcatttgaataaaactggaatcaagtcacttttaagaccttctgatgaaaataaaatgtttgcataccaaataaaaacgactttctaaagaaggattcggaagatgaaacaatactacaaaaaacttaaaatttaaacagctaattttactacttgaattttaaattaggttattatagaattcaccatacgtttctcccatatctataatatcaatgtcatttatacgataagaaatcgaaagaacatctgggtcataattaatatttatacattgatctttttgtaactttacatgttttgagaaagaagcagatgtattatatcttgcatttttacagctacaaacataaacattataaaatacattagaaaaagcttctcgatattcaagttcaacccctccatttctatcaatattacatgttgtaattggagaatccattctatcataaacttcctttataatattccacatttcaattgttaaatgtgagggaatattccactttgtagcatacttgttaaatgaagacatacattttgcagcacaactcatcgcctgttctttattcatagcattaaaatttgatttatttttcaaacgtactaaatagtttcgttattaacaagttaaaggactttttttattctataacatgtgtattctaaatttataccaagaatctaacttactttgtcatggattagaataaatcaaagaactattttccatagattacaggaatattattgcacaaaatatacatattttccataactttgcagcgacaaaggatcacacaaatggaatatagcgtagaagaactaaaaagtgcattaatagagaaatgcaagagtgaaggtatcctgtatgcaacggttgcaatggaccgtcgtactaaagaaatgattcttcctgatactttacaaggagctctgaaacatccggaattcttcgtatgtacctgcaagaaagtaaaagaccaatatgtagtggaggagattactaaagtgtaatactccccccagtcttttattttttattcgcccagttcacttagcaaatcgtaggaaggagcaaagaaaagtgttcccgtaactgctgtactaaagtccagtaaacggtcggtattgcctaccggattgccaataaacatactttccaacatctgccgggtagtagtgaacgtacttgcatagccgatgaagtaagtaccatattctcccttagacgtattggcgaatggcatattggcacgcactattttcaggtcatcaccaatattagtgacggcattatgcgcattttgaggtttctcctcgtcagacagttcgacatcgttaaacttacgacgcccgatcactttctcctgttcttccacaggtaaggagttccacgcaaccatatcgtgaatatacttctgcacaaagacatagctgcctcctgcaaaatcagcatcttcctctcctacaactgcaaaatgatagggattttcatcaaccgccggattctccgttccatccacaaagccgataatggctttgccatccatatatctgaaaccgtgagtttcgtcgacaggttcaaccacgccttgaagtttctcatcgatgatagatgcaaactcaaaacataatcccatctgttttgcacggatatgaaacaataagtcgcccggagtagaaactgccgtatgcttctcgccttttatctcttcgaaagttttcagttctttgggttttccctgttccgggaaaagacggttccaggcatcggctccaaatcccatggtacaactgaacatcatatcaggaaaacggttacgcatactgcgaatcagggccgagaaattagcacacacatcttttactttgccaagagtttcaggcgaatcttttaaagtataaacaataaaaataacattttcgccttgtttccccgctacgtcttgtgggatattaccaccaaatgaatgttgataaggattcatatttttcttttttttctattagtttcgtcaatgaaatagttctgttctaactcatctttttattaggatcttcaatatatgcggcagcccctttatccataaacagttctacattttgcgcatgatgagccacataggctgcgggaccagtgtctcccgaattacagatttcttctactacatcggctttattttttccggtaatcaggaaaatgacatagcgggcattctgaatggggtatcccgtcattgcgatacgcttctgcccgttacggggatgtgcactgaccacataaatagagtttgaagtcagcaaatcttcttgcccgggaaagatcgaagaagtgtgtccgtcatctccggctcccaacagtataatatcgaattcgggccaaccacgcttaaacggcacttgctgccggactaactccgaataacgaaccgcctctttcgcaggctttgcctctccacggatacggaatacattctcatagagaataggagtgatacccaaaagaaggttgcgcatcattccgtaattactgtccgaatcatcgggaggcacacaacgttcatccacccaataaatccgcatacggtcccaaggggtaatttccatatattcattcgcccataaatcgaacatcagagcaggggtattaccaccactaactgcgatattgaacactctgtccggctcttcattcatgatttccaccaggcggagtatcaatgctcgtgaagtttcaattgatgagggaaaaactgatagtttcataattcacaatattgatctgtatttgtcaaattcttacaaggattcgtccagtcagccccatgttcgtgcatcattgcttcactttccaaaggtccccacgtacctgcgggataaccgtaaagaggcgcatcggggttatctttccaatagcggagcaccggatcgaagaatttccatgaggcttctactgcatcacttcgagtaaataaagtcggatcgccctggatacaatcatctatcagacgggcataagcgtcaccactaggcacaccgcccaactgtgcataactgaaatccatcgtcacctggcggacttcgaaacctgcaccggggactttcattccgattttgagcacaattccttcattcggttgcaaacgaaggatcaatttattagcccgtggacagttgccactagcacaatgaaacatctggtgaggtgtttcccggaaatgcacaacgatttccgttactttcgtcggcatttgtttacctgtacgaatgtagaacggaacgccactccagcgccagttactaatgcccagtttcatggcaatataagtttccgtgcgcgaatcgggagccactcctttttcttcacggtatccttttttactaccggaggctgtatattgtccgcgaacaatatgttcattcaaatcgatatcattcaatggagtaagagattcgtagaccttcaccacttcattacggaaattgtctgcattgaaaacagcaggcggttccatagccgtaagggccacgagctgtatcagatgattctgcaccatatcccgcagcgcacctgccgtttcatagaacccgcctcgttgctcgatacccagattttctacggctgtaatttctacgtagtcaatatagttacgattccagagaggttcgaagataccgttggcaaaacggaaagccagtacattctgggccgtttccttaccgagaaaatggtcgatacggtaaatttgatgctcattgaaaacagaggcatacgttttattcagttcaagtgccgactcgagatcatagccgaaaggtttctcaacgatgatgcgcgagtggggagtgttaagtccggcagctttcaaatagaggggcactactccgtaaagtgatggcggagtggcaagatagaacagcagattgtccggatctacctcattagtcaattcaaccagacgttggcggagttgcgggtaaccttcttcttttgccgggtccatcggtaaatagtagagatgggagacaaatgaagccataagagctgtgtcctgttcttcagacttgacaaacagttgtagttcttctaatatataggaacggtagttatcgtcagaatagaccgtacgcccgatacccaatatggaaaactctccggtcaaccgtttttcacggtagagggagtaaagggcaggcatcagcttacgcttggtcaaatcacctgacgcaccgaaaattatcattgcaaatttatccactttattaatttctaaatatgaattataggtttactcaaacattataggtgcccgatttcgtatctcctccgtggcctgtccagttctcgtgaaagaactgtccgcgcaactcatccttacgctcaaaagtgtgcgcaccaaaataatcgcgttgtgcctgtacaaggttggcgggcagatcggcagaagtgagcgaatagaaatagttgagggcagaggagaaagcaggaacgggaagttcttctttcatggattccgccaccaggctcttccatccgggaagcaatgtcttcatttcttctttaaaataaggagccaacaacaagtgtttaggcttgtcggtggcttcgaaggcagctgcaatatcgttcaggaatatactgcggatgatgcatcccccacgccacatacgcgcaatggaagccaggtcgagatgccagccgaaagcgtcggaagcacgttgcaacacggcgaatccttgggcataagagacgagtttggaagcataaagagcagaaaagatattctttacgagttccgccttattatatataggttgtgtatgttgacactggaattgcttggaagccaagtgacgcaagtctttctgtgaagaaaggcttcgttcgaataccgccgtggcaattagccctaacggcataccgagttccatcgcattgataaccgaccattttccggttcctttctgtccggctgcatccaggattttatcaatgagataacctccggatttgtctttatgccgcagaatgttggcggtgatttcgatcagataactgcggagtttgccttcgttccaacgggcaaagacatcagccatttcctcattggtcagatcaagcagctttttcatcacccaataggcttcggcaatcagctgcatatcaccatattcgataccgttgtgaatcatcttcacaaaatgaccggagccggcaggacccacccattgacaacaaggagtgccgtccggtgcttttgccgcaatactttgaagaatcggtttcacttccggccatgctttttccgaaccaccgggcatgatagaagctccattcaaggctccctcttcaccaccggacacaccgctaccgacgaaaagaaatccctttgattccgccagttggacacggcggttcgtatcttcgtaattagaattaccgccatcaataaggatatctcccggtgaaagcagcgggaaaagctgatccatcagttcgtcaaccggacttccggcacgaaccatcatcataatcttacggggaatagctatcgaatctacaaacgcctttatatctgtgaatccttcgatgtttttaccttttgcacgaccattcaggaagcgttctaccaccccctcttctactccgggaacagtacggttataaaccgacacgtgccatcccttactctccatgtttaaagcaagattctcgcccatcacagccaagccgataagtccgatatctgttttattctgatttgccataacttgtatattttgaatattctttatcttagtaacatttgaaatgcacatttgttcgcaatattttagattaaaatattatttttgtggtctacaaataaaatcaaggatgaagaagatcaaaatcggtttgttggcacgcatcgttatcgccatcattttgggtattgccatcggcacagttttcccagctccgctagtgcgaatatttgttacgttcaatggcattttcagtgaatttcttaatttctctatcccattgattatcgtcggactggttactgtggctattgccgacatcggaaaaggcgcaggaaaaatgctactcgtgacagctttgatcgcctacttcgctactcttttttcaggctttctctcctacttcacaggagtcacagtatttccttcgctcatcgaaccgggtgcaccacttgaagaagtaagcgaagcgcagggaatcctcccctacttctccgtctccattccgccactgatgaacgtaatgacagctctggttttagctttcacactagggttaggactggcgtcactcaacagcgacgcattgaaaaatgtggcacgtgattttcaggaaattatcgtacgaatgataagtgccgtcattctacctttgctaccgctttatatcttcggcatattcctcaatatgacacattcggggcaagtatattctatcctaatggtgtttattaaaattatcggagtcatcttcgttcttcatattttcctgttggtttttcagtattccattgcggcattgtttgtgcatagaaatccattcaaattgcttagcaaaatgctgcccgcttacttcacagcattgggtacacaatcatctgcagccaccattcccgtgacactggaacagaccaaaaagaacggagtatctgctgaagtagccggatttgtgattccgctatgtgccaccatccatctatcgggcagtacactgaaaattgtagcctgtgcactggcattgatgatgatgcagggaatgccgttcgacttccccctgtttgccgggtttatctttatgctgggtatcactatggtagctgctccgggagtcccgggtggagcaatcatggcttccctggggattctacaatccatgctcggtttcgacgaatcggcacaagctttgatgattgcgctttacatcgccatggatagtttcggtactgcctgcaatgtaacgggagacggagctatcgctttgattatcgacaaaataatgggaaaaaaccgtgctgaatgactgtgctgaaaaataattggaaagtcacttggctgggtcacaaaaaatgccgacatttgcacccacattttcaattatataaataattagcgtatgaaaaaagccctaatttcaggcatcaccgggcaagatggttcttatcttgccgaatttctattgcaaaaaggttacgaagtacacggtatactccgtcgttcttcttcgttcaatacaggacgtattgaacatttgtattttgacgagtgggtgcgcgacatgaaacagaaacgtacgattaatctgcattatggggatatgacagattctagttcgttaattcgtattattcaacaggtgcaaccggatgaaatctacaatctcgcagctcaaagccacgtgaaggtttcgttcgacgttccggaatacactgccgaagcagatgctatcggcacgttgcgtatgctcgaagctgtacgcatcctgggactggaaaagaaaacccgcatctatcaggcttctacttccgaattgttcggtaaggtgcaggaagttccacaaaaagagacaactccattctatccccgttctccgtatggggtagccaaacaatatggtttctggattactaaaaactaccgcgaaagctatggtatgtttgctgtaaacggtattttgttcaatcacgagagcgaacgccgtggtgagacgttcgttacacgtaaaatttcgcttgctgccgcacgtatcgcacagggcgaacaggacaaactgtacctgggtaatctggattctcttcgcgactggggatatgccaaggattacatcgaatgtatgtggctaatcctgcaacatgatgttcccgaagatttcgttattgctactggagaaatgcacacggtgcgcgaattcgcaacgttagcattcaaggaagcaggtatcgaacttcgttgggaaggcgaaggcgtaaatgaaaaaggtattgacgtagctaccggaaaatctctggtagaagttgatccgaagtatttccgtccatcggaagtagaacaattgttgggcgacccgactaaagctaaaacactgttgggctgggatccacgtaaaacatcattcgaagaactggtaagtatcatggttcgccacgatatggagaaagtgagacgaatgattgctaccaaacattaaaacttgctttactaatagaatggaaaagaatgcaaagatatatgtagcaggacaccgcggacttgtgggatctgctatctggaagaatttgcaggataaaggatacaccaatctggtaggccgcactcacaaagagcttgatctgctggatggcatggctgtccgtaattttttcgatgaagaacaaccggaatatgtattccttgctgctgcctttgtgggtggtatcatggcgaacagcatctaccgtgccgactttatctataagaatctgcaaattcaacagaatatcatcggagagagcttccgtcaccatgtaaagaagttgctcttccttggtagtacgtgtatttatccacgcgatgccgaacagccgatgaaagaagatgtattgcttacttcaccgttagaatataccaacgagccgtatgcaatcgccaaaattgccggactgaaaatgtgcgagagcttcaacctgcaatatggaacgaactacatcgctgtgatgccgacaaacctttacggaccgaatgataatttcgacttggaacgcagtcatgtactgcctgccatgatccgaaagattcatctggcacactgtctgaaagaaggaaactgggaagctgtacgcaaagatatgaatctgcgtccggtggaaggtgtaaatggcgacagtccgaaagaagaaatcctggctattctgcaaaaatacggaatcagcgaaacagaagtcactctttgggggacaggtactccactccgcgagttcctttggagcgaagaaatggcagatgccagcgtcttcgtaatggagcacgtagacttcaaagatacctataaagaaggcagcaaagatatccgcaactgccatatcaacatcggcaccggtaaggaaatcaccatccgtcagctggccgaacgtattgtagaaactgtagggtatcaaggaaaactgaccttcgacagcagcaaaccggacggcactatgcgcaagctgaccgatccttcgaaactgcactctttggggtggcaccataaaattgaaatcgaggaaggcgtacaaagaatgtacgaatggtacttgaaataagaatttaaagaatcaatcaatatgctatgagcagaatgatttttgcttatagcatatttttttttgattatagcataatgatttttggttatagcataatgaaattagctataaccataatctttcctcctaccagcctgtcgcaatctcactacatcgcccttcccccatttccaaaaattcttccctcttaattcttcattcttaatataattgctatatttgcacaaattaataccaaatgtgcaaaacaatggaacaaagttttatagcctacattgagaatagtatcaaaaataattgggacctggatgccctgaccgattataaaggtgcaactttacagtataaagacgtagctcgcaagatcgaaaaactccatatcatttttgaagaaagtggaatccgcaaaggagataaaatcgctgtttgcggaagaaacagctctcattggggagtcacttttcttgctacactgacgtatggggcagttgttgtacccattctccatgaatttaaagcggacaatatacataacatcgtcaaccattccgaagcaaaattactgcttgtaggagatatggtatgggaaaacctgaatgagtcggcaatgccgctactggagggtatcctgatgatgaacgacttcaccctgctagtgtcacgcagcgaacgactgacttatgcacgcgaacacctgaacgaaatgttcggcaaaaaatatccgaagaatttccgcacagagcatatcgcttatcataaggatgaaccggaagaactggctgttatcaattatacttcaggaacaacaagttactcgaaaggagtaatgctcccctatcgcagtctgtggtcgaataccaaatttgcttttgaagtattagacctgcaagccggagataagatcgtatccatgctccctatggcacacatgtacggactggctttcgaattcctttatgagttctccgtgggttgccacatctacttccttactcgcatgccgagtccgaaaatcattttccaggctttcgaagaggtgaaacctaatctgattgttgccgtaccgcttatcatcgaaaaaatcatcaagaagagcgtgcttccgaaattggaaactcctgcaatgaagatcttactaaaagtgcctatcatcaacgacaagataaaagcaacggtacgcgaagaaatgattaaagcatttggcggaaacttcaaagctgttattgtaggaggtgctgctttcaatcaggaagtagaacagttcttgaaaatgattgatttcccttatacagtaggatatggaatgacggaatgtggtccgattatctgttacgaggattggagaagattcaagccgggttcatgcggaaaagctgtaccacgtatggatgtgaaagtgttgtcatctgatcccgagaacattgttggcgaaatcgtatgtaagggtccgaatgtgatgttgggatattacaaaaacgaagaagctactcaggaagttatcgacaaagacggatggctgcatacaggtgacctggctttgatggatgctgaaggaaatgttacgatcaaaggacgcagcaagaacctgttattgagtgctagcggacagaatatctacccggaagaaattgaagataaattgaacaacctgccatacgtggctgaaagtattatcgttcagcaaaacgaaaaacttgtcggacttgtttatcctgattttgacgacgctttcgctcatggcctgaagaatgaagacatcgagcaaataatggaagaaaaccgtgtggcactgaatgatacgctaccggcttacagccaaatatccaagatgaaaatctatccggaagaattcgaaaagacaccgaagaagagcatcaaacgttatttataccaggaagcaaaaggctaatataaagttagctgcatagagatattacttaaaccgaaaagagaaaggaatgaagataaagaaaacaatatttacggcagctatactaatggctgccgtttgtttaccggcacagaacaagagtgcaggtattaatatatctatctggaaagatatttgtacgcaaccgcatgacagtacacagacgacttatgtgaacatcggtctcctgtctacaatgaatcgcttgaacggtgtgggtatcaatgcattgggaagtgtggtacatggtgacatgaacggagtacagatcaccggattagccaatctggcaggtggaacaatgaggggtgtccagctagccggtatcagtaatatcagcggcaacaacaccgtagggctttctgctgccggactagtaaatatcactggcgacagaacgcaaggagtaatcatatccggtttaaccagtatcggaggagataatacctcggggttaatgattagcggtttcatgaatgtgacgggcaatatggcttcggggctacacttttccggagcggcaaatattacagggcagagcttcggtggcttgatggcttccggacttttgaatgtagtaggcgaacacatgaacggtttgcagatggcaggaattgccaatataaccgcatcgaaactgaatggggtgcaaatagcattatgtaattatgcaacgcaggcccgcggacttcaaattggccttgtcaattattacaaagaagatatgaagggattccaactcggattggttaatgcgaatcctgatacaagagtgcaaatgatggtgtatggtggaaatgctacgcctgccaatataggtgtacgcttcaagaaccaattgttttataccattctgggaatcggctccatgtatcagggattgaatgataagttttcggcaagtgcatcctatcgtgccggcttgtccttcactctttacaaaggcttatccatcagcggagaccttggctaccagcatatcgaggctttcgataacaaagacgaggtgattccgaaacgtttatatgcattgcaggcacgtgccaatctggaatatcaaattaccaggaagttcggcatctatgcaacaggtggttatgggttaaccagattctataataaatcaagcaattacgataaaggagcgattatagaagcaggcattgttcttttctaaataaaattacaatgaacgttgagatgaacataactacaattagagaataccagccaacagataagaatgctgtaatagatttaatcagacagaacacgcctgcatattttgcaccgaaagaagaagctgattttagtaactatctggatagcgaacgtgaactttattttgttctattactcaacaagaaggttgtaggctgtggcggaataaattttacaaaggataaagccagcggaaaaataagttgggatatcatacatccccagtaccaaggcaaatcgttaggagcacaattattaaaatatagaattgaaatattaaagtccattgatggtattcaaaaaataaccgttagaacttcacaattagcctataaattctacgaaaagcaaggattcacactgaaagaaatccaaagagactattgggccaaaggctttgatatgtatagtatggaatataacgggcattaataataaaagtgcaattcaatattaataatgaattacacttttccttatgtatcaagtaaataaagacactatattttaagcattactaaaactatcaaatgataaatgatggttttaagcccttatcatttcaatctatcacactttttcttttatcagaccagtacgataagcaacaagcagtttcttcaaatcctgtatttgagtcactagttcttttcccttatcggtatctttcaccatcattcgttgcgaattaaattcgagaacgaagttggtcgatttgatatcaagcccctcttcaatggctttctgacgagactggaatggttcgtgctgtacgagttgcataccatgagaatgataaacaagcgtataccccgcaattcccgtttccggctgataagcttttgaaaaaccgccatcaataacgaaaagcttgccattggctttcataggttgttccccctgaatcgttttcacaggcacatgaccgttgataatatgcgaatgaggccctgaagctccaaactctgtcaaaatctggtcacaaatatcttcccggttacgcaatgtgtaataatagcctttcttttctttatgcaactctttatcttctacaaaataacgctcaaaagtcgccatcttatctttatcaaacaaaggagcttccgggccacaccacatataccagatataatccatagcaaattccttatcctcctctccttcttcatcgaaataagcggtacggatcaattgatcggctttatccagcaatttatgtccccagtattccttaccacgtattttgacatgtttaaagctgccatcctcattcagaggaacagaagcatgataaagaagattcgagtttgaaaccagatacatgccgccataggtaaacagacaacgcatgtgcttcttcaatttctcactattcataaatgaataatgaatcttttctaccaattcacgttcttcttcagtcagtcggtaaggatctgccggatctacagtcgggaaattggtatcacgcaaagcatattcttttccttcatatacaaagacgccgcgttcaaaatcaatcttctccagaagtttacgattagccattccgaattctggacggcggtcgatgatttcagcttccagcttaaactggataatggtaatggctttatgcatttgagtaatcagacgcaaagtcttctcattataatgagcatcggcaaagttcattttcggcatgaaaatcgtgcaaggatcatcggcatacgtatccattgcaaaagtagccaatggaagcaaattgattccgtatccgtcttcaagtgtccccagattaccatagcgcatagacatacgtatcacgttagcgatacaactatcattaccggaagctgctcccatccagagaatatcatgatttccccattgaatatcgaaattgtggtaattacacaatgtatccataatgatatgcgcaccaggaccacggtcgtaaatatcacctacgatatgaagagaatcaatagtcaagcgctgaatcagattacacatagcgataatgaaatcgtcggcacgcttcgtagtgataattgtgctgataattacattaatataagcatgcttattcggttcgatagacgattcgtgcaataactcctgaatgatataagagaattcggcaggcagtgatttacgaaccttcgaacgagtatatttggaagacacgttctgacagactttcaccagttggttcagcgtaatcagataccaatcatccagatccttttcacgggccttcaccaattgcagtttctcttcgggataataaatcaaagtacagatttctttcttttcagcttcacgaagagtgttgccgaatatttcatttactttacgttttaccgcaccggaagcatttttcagtacatgctgaaaagcttcatattctccatgaatatcagtcaggaaatgttccgtccctttaggtagatttaagatagcctctaagttgattatttccgtactggcatcagcaatggtaggaaaacttcgggaaagcagttgcaggtaacggagatcactcacaatgctttcaggagttatgttactttgagcagtcattctatttactattttactatttacaatttattaattggcaacttattattagttgacaacttaccatttagtaactcaaaaaaggaatttattaattcctctcctttttcttgttacaaatttatctattttatacgattcctgattaagaaatgactactttttatttacaaatccatcatttctcaattttcaattctcaatttaacaagaacattaacagcacttgagcgataatcacccgcaggaacatacacagcggataaacagtcgcgtaggctacggatgggttgtcgccgggaattgtatcgtttacatagttcagtgccatcggatttgccatacttccgcacaacataccggatacagtaccgaaatcaatcttcatcatcttgaaagccacaaaccccaccagtacggttggaacaatagtcaatccggctcctaaagcgatccataacaaaccttccggacggaatacggtgtcaaaaaaatgagctccggcatccagtcccagacaagcaaggtacatggaaagtcccaaggcacgcagcatcagattcgcactacgggtggtataagtaatcatgtgtatccgtggtccaaaagttcccagaaggataccaacgataatcggtccacccgctaatcccagcttcacaggagtactgacacccggaaaagagaaaggaatcgcccccaatgccaaaccgagtacgatgccgataaacacaacaaccagattgggttctttcaaactttttacagcatttccaagtactttctccacattctgaatagcagcagcctctcccactaccgtcaggcggtctcctaattgaagtaccaatcccggagtagcaagcaactgcacacccgaccggtaaacgcgactgatgttaatcccataatgatttctcaaccggagtgaaccgagtttcttaccattcagttcagggcgggtaacgacaatacgttgcgaaatcaattcactatcaatcgcattccagtcaatgtcctctttattccaatccgtattttcctgttcaccaaaaagcacggtcaaggccaaagcatctttctccgcagttaccaccagcaaacggtcaccttccttcaatatcttgtcagaagtcggaatacttacatgtccgtcacgccataagcgggagatgacaaacttcgggtaactcatgcgagctatatccttgatgcttttattgaaaatagcaggattgtgtacttgaaacgctgcaatgtaggttttgttcgcatcgtctttctcttttatctccaagtcttctttgcgaaccaacactttgcgaattaataaaacggcaaggattacaccaactacccccatcggataggctaccgcacatcctaaagcaggagtactgctgtccattcccatctgtttcaatgtttgttgtgcagctcccaacgccggagtattcgtcgttgctccacaaaggataccaaccatatcaggaagagagacacctgtcgcataactggccaccaccgtcaacaatgttcccaacagaacaactcccaatgccagcatattcaatgtcacccctcctttgcggaaagagctaaagaaaccgggaccgacttgcaaaccgagagaataaacgaaaatgaccagtccgaaactttctgcgtagttcaacatctgcggatcgaccgaaagcccgagatggccggcgaggatgcctgcaaaaaaaacaaaagtgactcccagggaaactccccagaaatgcactcttcccaagcccagaccaatggcagaaatcaatgaaagtaccacaacagcctgtaaggcagaatgttcgagaaatagactatataaccactccatgtatataaaaactaatagggcgcaaagataaaaactatttagtccggttcaaaacttttaagctttcatttcgcgccctatttataccctgaatcatatatcctgaaatcttattgattacccttttactccgttacctattattttgttcctaataactatcctatttctatcttaactatcttatccttctcttttcacctgcatcttgttatccctcaaacgatctttttccctctgtttctttccgttttatctttcatcatttcccctgaaactccacaaagttatttcgtccgtccagataaccgcttaacctgtttccaccgatgtacacatcatccaggtatgaaacatcattcggtccgtatgacatacgaatggaagtctgcgcataattctcccagctccaacggaaattatattcatactgctctactgtcccgttaggatattccacccgtatatagtcaattcccgtacgatctaaaaagaaatccagttcctgacggcaatagttaccgtccatgtcccggtagaaactaacccaggtacggctacacaaatcagccgaacgattatagtatcctgcaccattattatcatcatcatagaaactgtctatttccacttcgcaagaggtaaaacttaccatcaatatagccatcaaagccaaaccgaagtatttaaatgtgttcgttttcatattcctttatttttaacggttctctaattattatctatcatttatctttcgatagaacaaaagtagagaatgaattttccttatgaaactgaaaactcctacttatcgggaggaaattgcctaaatctaggggtaaatccccccaatgaagtctatttcaaagaattcttgtatctttgcctcctgctaacaacacatgaaatcatctgtcgcatgaagtcaatcaaatcccatatcacccaactgctgaaatccctcaatgagggagtattcgaaaaagaacataccatcgcactctccctattatctgccatggcaggtgaaagtatctttctattgggccctccgggagtagccaagagcttagtggcgcgcaggctcaaactggcttttaaagatgcggatgcttttgaatatctgatgtctcgtttcagtacaccggatgaaatattcggccccgtctccatctcaaaattgaaagatgaagatacatacgaacgtattacaaaaggatacttgccgacagcatcgattgtcttcctggatgaaatatggaaagccggtcctgctatccaaaattctcttttgacagtaatcaatgaaaagatatatcgcaacggacaatttacggtgcgtgttcctctgaaagcgctgattgccgcgtccaacgaactacccgcaaaaggtgaaggactggaagccctatacgaccgtttcctgatccgccagtttgtcggatgcattgaacaggaatatgctttcgaccagatgatttcttctacacgggaagtagaacctgaaatcccggcaaaactccaggtagacgatgaattatacaatcaaatacaagctgaaagtgagaaagtaggtatccactataccatcttcgagctgattcacaatatcaaacgagaaatcgaacaatataatacagggcgggatgaaaacacccctccgatctatatatccgaccgccgttggaaaaaaatagtaggtctgctccgcacctcggcctatctgaacgaatctccgggaattcacttctccgactgcttgctgatgagtgcctgtctgtgggatgaagtttcgcagctccccatcatcgaaaacatagtggaacagtcgattgcacggggaatcaatacatatttattgggagaaaaacgactggaacagaaactggatacattgaaagaaaacatgaagtccgaacacagcctacgggaacttagcgatccgggaatccaggtcgtagataccttctatcatcgcatagaaggttaccacattgccggaaatttactcatctttgcttcggattaccagtctttgaggaaagacagcaaccggttgttttatatccaacaggataaattccgtccggtcaacaaaatcctgaaagcctacgatttcgtaaagaacaggaatatcgcacaaaagaatatttattccctccgaaaagggaaacgatctgttttcgtcaacaatcaggagtatccactactatgttatgataattgcgaacctttgccaacacagcaggacggcagtactccgttcgaatttacattgcaggaagtgatagatttacttcatcaaatggaggtagaatataaaacaatctccgagcgggaaacagcatatacaaaggaacatcttttcttaagttcatcgcaaaaaagcaaaattaagcgaatcttaggggaaactgcacatatcatagagaactaccggaacgaacttcgcatcatcgctcatgcccatgaacaagagaacagagagtattaggctcaagcacctgcaagacatttattacgaaaaattgcagggaatagcctatgatgtgtacgacgaacaactacacaatctgattatccgtcccgaagaactggatgcggacattcacctgtattttcgtcacacacaaccctccctgcaagatttctactcccgttatgcatcgcaatgggaatactttcatgaaatgaatgaagcatcggacgcaaagtttcttcaattcctgaaaaacagcgcataccccttctccatgaaatatcacctggtagacctcaacgtaaaatactacctccaacgttttaatgtaatcagcccgcgttccaaagaatggaaagcgttgtggactctttttttcgacaagtggcatacgctactctcgaacaatgagttcaactatcagatggaacatatcgagcaactctgtgaggatttctaccgtattcaactggcattagccaaaaatcttccggtacgcggtggctcacgcctcgtctggctacttcgcaatcataaacagatagcggaacagattttagaatacgaagaaacgatcaaacgaaatcccgttatccgcgaactggtagaaatcttaggcaaaaaacaccaaagtagccggaaacgtttcaaaatgaccgcaggtattcaccgggaacaaattatatctcatgccacccgaagtgatattgcaggcatttgtgaaggaaacgatttgaatagtcttctccctctggaatattgttatctggcggaaaagaacctgcaacccatatttttcgagcgtttcatagagaagagactacaagtcatcgattatcaatcgcacgagaaacaaaccatcaatgataagaaaacagtaggaaatgaagtttccgaagaagctgaaggccctttcatcgtttgcctggacacttccggttctatggcaggcgaacgggaaagaatcgcaaaatctactctacttgccattgccgaattgacagaagtacaacatcggaaatgttacgtcatcctcttctccgatgatatcgagtgtattgaaataaccgatttagggagtagtttcgatcgccttgtcgattttctaagccaatcttttcatggtggcacagatatggaaccagtcatcacacatgctttgcgaaagatcagcgaagaaggatatatggaagcagacatcatcaccgtatcggattttgagatgcgtcccgtcgatcaactactatcccggaccatagaacatgcaaaagcaaaacagacaaagatgtatgccatttctttaggaggcaaaagtgccgagaccagttatctgaaattatgtgataaatattgggaatatagtgttcaaaacgctgaaagtcttaataaaaatagaattgaagaatcaaatatttaatcaatgttataaaacatctcttttttcttgttttatttgcaaattcgacagaagtccgtatatttgtactgtgtttttcatagtattagatttaaggttaacaaaagattggctgtctgggatagatagcctttttttatgtccttttctcacgtcaaatataccgtcactatcccatccggatgtttaccctatcccatgaagataccgtcactataataagcggatagcgtcaatatgtttcaagttcccattccatcgataaaaattaaaagctttcgaaaaaaaattcttccgtttaacatttgaaacatagcaggttatctcatttcacaaaaaacaggtaaaaaaaatcttgctaaaagatttgcgtagtccaaaagttccccctatatttgcaccgcatttgagagagaatgcgggttcaaggaagtttgggtgagtggctgaaaccaccagtttgctaaactgacgtactcgtaagggtaccgggggttcgaatcccccagcttccgcaaaatctcaaaataaaaagagctaagttttatagacttggctctttttaaatctatcaaactccggtgggttcgtctaacggttaggacacatgcctctcacgcatgtaatacgagttcgattctcgtacccactaccaaagaaaaagaggaaatgcagtttaactacatttcctctttttctttatagatctcgaaataagattccttatcaatcctcaaccggactctatcctcccttttctgccctgccagattcacaaacagattgaaatacagttggctgaaagaaaggttggaacgatcataagtaatatcaaatgtccaggttctacgaaaagaatcgaatgttgcatacgattgctcaccccctttacacataaacacttccgggaaagacgtaggaggataaggctggaataaacccgctaattgaacataaatatagtcaatcatccattcgtctcctgttaaagtcaattctccctttaaacggagtttgatggcataactggcagtcacgtcggacgaagtataaacaggaacctggctttctgccggatagttgccgtctttatatccaagactcatcgttagtttggatagaccgacaccattaaagccactcacctcctgatctgccaaccggtttttcagactgaccataaatgtcagtttaccgagcgtcggatcacccggatattgtgcaagcgtgtccaatacataatcttcggtattgtaactacgggctattaaatcacccttcccagcctccaaagccggaccacctctttccacatccacgttgccaaccggataataaatagcatcattatcccttacgcaaccactcaaacagaacagcaacactgccaagcctattatcttattcattatcatcttacctcttgattttgcagacaaagatacatcttttttataccacacttgatttatgtcaaccgtttttagtatttttgcacacatcaagacagaaaagatatggatacattattaagagagactgtaaatgctgttgtaaattcccgctttccggaaatgagtatagaaggaagacgacagatagaaagtatactgattcgtgaagaatttcccaaaggagcaatagcgctgaatgaaggagaagtagctcatgaaatcgtatttgtcggcaaagggatgcttaggcagtactattacaagaatgggaaagacgtgaccgaacatttctcatacgaaggatgtatcgtgatgtgcattgagagttttctgaaacaagtacccacccggctaatcgtggaaaccctcgaaccttccattatctacctgttccctcgcgacatgatacaaaaattggcaaaagagaactgggaaatcaatatgttctaccaaaagatactggaatactccttgattgtgtcacagattaaagcagactcctggcgctttgaatccgcccgcgaacgctataacctcctgctcgaaacacatccggaaattatcaaacgtgcacctctggcatacatcgcctcttatcttttgatgacaccggagacactaagccgtgtgcgctccggtgttctatgattttagcggcttttccggtatcctttaggagacataccggtgtaatgcttgaaatactttccaaagaacgactggttagcaaaattcagccgatcggcaatttcctgaatattcatgcttgaagaattcagaagtgcttttgcttccagaatcaccagttcgtcgatccactctcccaccgtttttccgctgacctctttcactactcccgaaagatgcttcggcgtcagacacaactggtcagcatagaatttcacgctccgttcagactggtaagactccactaaagactcataaaaacgttcgaaaatatattctttccggcttttatttttcatggtagtagcattggctggcgcatgattggtaaagatattacaaagttcaaaaaagaacccttgcatcaagcccattaccacttctttacgatataaagcctccttattcttcaatcgttttctgataaatgcatgatattccttcacagtctcctgctcctgcggtgtaagattgaaacacgggtaatctttcagataaaagaataaggaaagcacattactgatcttaggcaatgtctctaacaagttcttcgacacagcaaagaatatcgctttaaagtcggaactgaaacaccgctgttcgacaatctgattaggcagcgcgatcaccattaatccggggaacagttgaaactcacgtaaactaatattaaaagtaccagtaccttccaggcaaagacctaccgtcaacacctccagtttagtcggtccattatacaacgatataacgctctccgtatcgaagagcgctatatcgttatcaacaacatcaatgttgtcagaatctatatgtttagaatgaactaccgaagaaatacctactttgggaacattttgaatatacatactctctcttttttgcgacaaatataccagcatttaatcagatatacaagccgttcaagagtattatcagacataatgaacacttttagttacttattgaacagaccggaataaatatacagaatcacgttgggcagccggcactgtccatttctccggaacaaacttccactgattcagggctttggggttcatcgtacctttcttttcgatataattcatcaaatagaaacgaagatctttatctgtagagaaaattatgcggtccttcaaatcctcctgcggaatacccgatcctttcgtcaacagttctccaccaccattaccacgataagaatttaaggccactttatatatcttatccatacggaaaggagaaccgtccgccatgctcgtaatcgtaatcttttctcccttcggttttgtcacgtccaccgtataaataatgccggaagccgagtcgaaattaaaactgaagttctggaaagaagccctgtcttccgcaccttcccgaggtttcttcttgaaccagagcagatgatcttccggtgacttcatctggttcgtccacatataataagacatctccagaaaatccttaatctcctttccggacaacgtcatcacatacagcatattctcatacttatacaagttgaacatatcactgacaaacacatcccctttctttatctccgcatcaaacgaaagcggagcggcaaaagagatgtcagctccggttatatcgagctgtaaagtatgtatcaaatcaataaaagcagaaggaccgaagaaagcaggatgagtagagatactctcggtaaaagtgccgatcttcttggatacaaacttctgcaccgtctcatattgcggagcaaaacgcttcatgaaatcctcgctgattccgtaagcttccgtttctgtcaactcccctttgacgtccttgctctgcacctttccatctttcagtttcaaggtcacatcgacattagacaatacaattccattgctggccggatcgataatcaacaccgaatctccggctacattcatcaccttcttacattcgcgggcatgatcgtgtcccatcaatacaatatcgaatccaggtacattcttcgctacgttaagagaagcattctcattgtatttgcccgacattttgaaagcctcctgtccggcatgaaacaatccgatcaccaaatccggattctctttttcacggataatcttcatccatttgcgtgccgtctcttccatatcatcgaaacgcaagcctttccacagattttcagaaagccatgcagggatggcaggagtaatcatacccaataccacaatcttcacgccatcacgttccaacaccttataaggagccagatggggttttcccgtagacgtatcaatgatgttggcacccaacacagggaagtcacaagtggctatccaacggtcgaacacagcacgtcccgtttccacatcatggttccccatattaccggcatcatatttcatgaaattcatcatttccgaacaaagatgaggagacaccgtatctatataattatagtaataggcagtaggctgtccctgtaaaatatcaccattatccagcaatatcagattctctttatactgttcacgctctttctgcacgaaagaataaatacgtgccagactacccttccactcgtggcgggttataaaattgtaaggataataattaccatgtacgtcactcgtttccacaatcttcagcttcaccaccttttcctgcgccgcaacagacagtacgagacagaaaagcaagccataaataaatcctattcgtttcattctttttctatatttagcggatgcgaaaatacgaaccgtgccccaccggtatagtcaggatcgatccatatacttcctttccatttatgcacaatcaatttacagatagacaatcccaatccggttccctgggcgtactcattcagcttttcaaaacgctcgaacacaagtccctgtttttctttcgggataccgcatccggtatccgttaccgagaaaatagccatttgcttttcctcattcacagaaaagtccaaggtaatcttcccgcgtttcgtaaatttgtcggcgttggacagcagattaatgattacctgttgcatacgctgcacatccgtcaccatccggaaagtttcaaaagaagtggaaaacaagaactgattgtccgacgactgccgtgaaaaactaacagaggcaaccacctgactacacaactgcaccacatcacattcctcccacgtcaaagtcacccggttcgcctccagacgtgaaagatcgagaatatcattaatcagacgaagcaacaaatccgaattggttttgataatcttataataagactgctgttcatcctccgtgctaccgcccattgccagtacatccgaaaagccgacaatcgagttcaacggcgtccgtatctcatgactcatattggcaaggaaagcactcttcagacgattagactcttccgccctgtctttcgctacacgcaaatccttctccgatttcagaagctcgtctttcaaacgtttcgtacggaaataatagaaaagagagatacataagccaagtaccagaatcacgaacaaagcacaagcagaccatatctgataagtatattgctgatagaacgaaaccggttggttgacaagctgcactttaaaaggcaacacgcttgggtgcagcccccactctttcaccttccggctatccaataccgctttagagccaatgatcgaaagatgcttccccgtatcctccgggtgctgatccatccgtatggactccatagccatttctcctcccactttccgataatcgggcagcactcctcctatcgcccaatatccaaggctcaccgatgaaggagtaaaagccggaatggtaggagtagcttccatcatggcatacgtcgcatttcgcatgaaatacccctcgttcatatccacacgccacgttcccaccaagataaccgtattttcgggcagctgtctcaattcctcaacgatggtataaatagaatgtctccggccgtccatcaaaatcaaatccagatcgggaaacttcttcatttcttttcgtaccaacgcttgcatagtcactccgccataagtattgtccgagataaaggcaatgtgtttcgttttcggatagaaagcttgaatcatggagatattaccttctatatcatattgattgataaatcctgattccagttcgggaatatccagatgatcttcaaagatatcaacagattcgggcatccagcaatcaaggttttccaccgtatctttcggcaatatcaccacattgctactggccagactgcacatcaccggcactttcacctgcatttcatccctctgcgacaaataggcagcccatgcctcctgccctaataagataatttgtgccggatgcttttctccctgatatttagccagaatctgcgtcatcatcgcgctccataacggagcctccgagaagcttttacaattcatgttttcgatgacaatgtcgcgctgtcctcccaacttactatattcatccatataatcggaaatagtgaccgaagtttggtgtgctgccggattataagagcaaataatcagaataggtttcttatctttagagacagccaatacttccgttgactgcagaagccaaaggaaacagataaaaagatatccaagacgtcccagcataattatgcagttttgatgtgttaattcattaattgagttgcaaatatagtaaaacttgtcgggtttagcagatttatatgtatttttgtcgctcatttactctcaaaaaatacaaattatggaattatttcacaagatgatttccggttttctgggtataccggaaagacaaataagtagtacgctccatcttttgggtgaaggtgctacgattcccttcatcagtcgttaccgtaaagaagccaccggcggactggatgaagtgcagatagagcaaatcaaagagcaacacgataagttgtgcgacatagccaaacggaaagaaacgattctcggcaccatcaacgagcagggaaaactgactgccgaactggagaaacgtatcaacgacacctggaatccgacggaactggaagacatttatcttccttataaacccaagcggaagacacgtgctgaagtagcccgccagaaagggttggaaccgcttgccaccatcctgatgttgcaaagggaaaacaatcttagtaccaaggctgcctccttcgtgaaaggagacgtgaaagatgtggaagatgccctgaaaggcgcccgtgacatcattgcagagcaagtgaacgaggacgaacgtgcccgcaacgcggtacgtaatcagttcagccgccaggcagagattagtgccaaagtagtgaaaggaaaagaggaagaagcggcaaaataccgggattatttcgatttctccgaagcactgaaacgttgcacgtcccaccgcctgttggccatccgccgggcagagtcggaaggcctgctaaaagtatccatcaatcccgacgacgaggcatgtatcgaacgcctggaacgtcagttcgtacgtggcaacaacgagtgtagccagcaggtggacgaagccacagtcgatgcctacaagcgtctgctcaagccctccatcgaaacagaatttgccgctcaatccaaagaaaaagccgacgaggaagccatccgggtattcactgagaacctccgtcaacttcttctcgcccctccattgggacaaaaacgggtgctcgccatcgaccccggattccgtacgggatgtaaagttgtctgcctcgatgcacaaggcaatctgttgcataatgagaatatctatccgcatcctccggtgaacaaaacaggagaagctgcttccaaactccgcaagatgattgaggcctatcagatagaagccatctccatcggcaacggaacggcaagccgtgagacagaagatttcatcaacagccagagcttcgaccgtcagatacccgtgtttgtagtcagtgagcagggagcttccatttattcggcttcgaagattgcccgcgacgagtttcccgattatgacgtaacggtgcggggagcagtctccatcggccgccgcctgatggacccgttggcagaattggtgaagatagatcctaaatccatcggtgtaggtcaataccagcacgatgtagaccagacaaaactgaaaaaagcgctcgatcagacagtagagaattgcgtgaacctggtcggtgtaaacctgaatacggcaagcagccatctattgacttatatctccggactgggaccgcaactggctcaaaacatcgtcaactaccgggcggaaaacggagctttcggttcacggaaagagttgatgaaagttcctcgcatgggtgccaaggctttcgaacagtgtgccggattcctccgcatccccggagcaaagaatccgctggacaacaccgccgtgcatccggaaagctaccacatcgtagagcaaatggccaaagacctgaaatgtaccatcgacgaactgatagcagacaaggaactccgccggaagatcaacatctccgcctacatcacacctaccgtcggtctgcccaccttacaggacattctgcaggaactcgacaagccgggacgtgacccgcgtaaggctatcaaagtcttcgaattcgacaagaacgtgcgcaccatagccgatttgcgcgaaggaatgattcttccgggcatcgtaggcaacatcaccaatttcggggcgtttgtcgatataggtattaaggagaacggactggtgcacctctcgcaattagcggaacggttcatttccgatccgacggaagtggtatccatccatcaacacgtcatggtcagagtgatgaatgtagattatgaccggaaacggattcagcttagtatgatcggggtacagcaagactgattgcttcccttttttctccccaccacacgatcagaatcgtaaaaacaatcataagtactgtgcaaatgagcgagccttcaaaaccgaaggctccgccattcagtacgttttcttcgggcatacgcaaagtcagcatgctcgtcgtgaaattatttccgctcacctgataacctagaatcggaccttgaatccaattccagaaaagatgaagagagatagggaaacacagattccgggtataaagataggaagcacccagcaacataccggcaagtaagagattaagcatcggtaggaaagctatttctggattaaagatatgcataaacgcgaataatgccgacgagatgaagagcgccaggaatttattcatattagtatgaagcagacgtccgaggatatagccgcgcatcagaatctcttcaaacaacgccactaacaggaaaaacacccacgaccccaataaatccaacggcttaaactgaagaccggtgacttctatttctcccaaaacaacagagattccgaaacccagcaaatagagcaagattgccatcagaagtccataccacagtccactggcatgtccttttaaagaaagtcccaaatcagaaaacggacgacgttcgagacgaagcaagattacggcagcagtaagaacagccaaaagcatactggcctccacgaaaatataccctactactcccggatgacgagcctccactccaagaaccaacgacaagcctccgctaaccagtgtcccatacaatccaataaatatgaaaagtaccacaataaacagcgagatacatgcccacacaggaagtcttttgggttctttcttcccatctatgttgtctgcctccatttttacaatttgttaatccggctacaaaattagatataaaacataaaaaaacatcatgtattctctatttttcctatatttgtcagaacaaatctacaaaattatgaaaattaaactactattgataagtttcttactggccgctaatgcattaggagccgccgcccaagtgagtaagacgtattatgtgagtaagcccggtacgctgatttccatgatgactgaagaggaagccaacagtgtcacccacctcacactgaccggaaaactgaatgcagaggacttccggcatctccgtgacgaatttgccaatctgaaagtattggatatttcgaacgcagaaatcaagatgtacagcggaaaagccggtacttatcccaatggaaaattctacatttatatgccgaacttcatccctgcctatgctttctcgaatgtagtaggcggagtgaccaaaggtaaagccactctggagaaagtgattctttcggagaaaacgaagaatatagaggatgccgccttcaaaggttgcgagaacctgaaaatttgccagatccgcaagaagacagctcccaacctgttgccggaagcgttggcagacagcgttaccgctatcttcgtccccctgggcagcagcgactcttaccgctacaaagacagatggcaaaactttgcgtttatcgagggggaaccggtagagactaccctgcaagtgggcgccatgggtaaactggaagaagagattctgaaagcgggactgcaacccagagacatcaacttcctgaccgttgaaggtaagctggacaacgccgacttcaaactgatccgcgattatatgccgaatctcgtctctgtcgatatttccagaacgaacgcaacagctatccccgacttcactttcgcacagaagaagtatctgttgaatatgaaattacctcataatctgaaatctatcggacaacgggtatttagcaactgcggtcgcctttgcggcacgctggagctgccggccagtgtgacggctattgaattcggtgcttttatgggatgcgataatcttcgctatgtgttggctaccggaaataagattacgacgctgggtgataatttgttcggggagggagttccgagtaagttggtttataagaaataaaaaaaaaagaaattaccctgatataaattggtgattagtcaacttatatcagggtaaattatttgaatattaggacactaagaatctttagaattctgctttttccccaattcctcatgatttatctttttcatataactagttgcagataatgcaatagcacttcctccccataatccaaataacagaaagaataagtaacccaaatacgcattcatttccatgccaagaagatgcaaaataatttatataaaaaaatatccccaaaaactatagaaaaagcacaggtgagaataataacataaataatatctgaatttagaatctttcattttatattcttttttataataggtattacaatcagtgctaataataatggtaaagtaaaagccatgtccttcataaaagaaggctcatactcatagaaaaacaacgagaatagtatttttataaaacatagaatatacagcaagttttgtatatatataagatatttaccaatttttccaaaagacgtcatctaatttatttttaataggttcaaatatatcataagcattatgttcttcgctaatttttgattgagtgtctgttgcagcataactctaaacacactatttgtttttaatttcttgtcctcttagcgaatatgagattctttcttgctggcttgcttcattttacgttcttgtttcttcttattaatctcttctaaagtatatttctccgctttcatggttattttatatccaagaaataatcctattaaaagcaataacagataattgtataatgtagacttatattcaatagaaaaagctatatataccacaagaaaacaacaatataatcgcgttattattttatcagatttcaaatataatgcccgaataagaccttttccctttaatggctgtttgagtatctctatataagggaatagataactcatcattccccctatcgctataatagataacgcaattgcaagtattaccctaataataaatattaaagcaggatactcaaataaaaaagaggaaaaaatacaatagggaatcatcataaagctaaaccatagtagtgactttttatatattgctataaatagatatctcatataataataagttcgtcgttaaagtttatttatttaccatatttcatcttgtagtttatataccctgatgtgagttcactaaactttagctattcacatcagagtaataatgttgaggttttaaggagtaatatttttatttgcttgatctactatatattgattagctcttattgctattttgtttccaagatatagtccaaacagaagtaatattaaataaactattgctttttcgtgactatagaagaccaaatatattgcaaaaaaaattgcatatatcacatctatatcccggctaaatttcaaacaaaaagatttaacaatattatttgtttcagttttcttttctttcagacctttattccttgacaaaaagtttaacatcttgcctgtcagccatgcaatccatgaaattagtaataatattataacaataaacatatattcaaattctcctaaatcaggatggaataagcaatgaattatcattaaaatactattaaaaatagtaattctcttaaatattaatataaaaatatctcccatatattgcttttattcaaatagtttttttatccaattataaatatcccctacataatctgttgaatattcttctctaccttcaacttgatttgtatgagtttcataagcatcttgagtgggatcaggatttgttaattccatatatgttctatctatagctaaccctattattacttttttcccaacttttattattctctttttatctttaggatctcttttcggagccggatcaccattaggcatcatccctgacacgttagtatcaatactttccgccacattcgcctgattcctgtccaatccttctttattcctcctgtctctttttctttggtgctcatattcaggactaatcgcattctttgcctgataaaataaaagagttccaaaggcataagacattttaggagtatgatttataatctgccctaattccgcaaatttccccgatgtatgtctcattatctgttgatctgaaggcaatctataagattgcgtgttcgtcaaaggataatagaatggtagaggaagaggggatggaacggggatgacttgcttgccatcaggatcaatatgcttcaccggattatttaaacaatacccgtaaggagtaattgaataattcttttcactcatcggatctgccacatgccatcttcccaataccggatcatacatccgcgccccgtaatcataccaatccagaccaccttttctgtccagttcttttccgttgtacttgtaaagctgaaccgaaggggtggatgaagccaagattcctccgaacggatagtaatgattcacctcttccgcttcacgatcttcattgtatacgacacgaacattacccaagtaatctttcaagaagaaatgataactataggaaacatcgtccgcgaaagaaacaaaaccttcaccatcgagaagaatcttgtcgagacttccgttttcatagatcgctttaccacaataatcagtggtggtgatagaatctcccatcgcatggatgacctccagtttcgttccgtcggcactataaagatagctgattgtacgtccgtcggtaaactctatcgcactcggcaaatttaagcaattataccggattctcgaaattcctttgtttaaatcttgaatcaaattgccatttaaatcataagcatattctgctgatgatcggatgccgtctttaaaatcagtggtacttccatacatattattctttgcgtggtctgtcacattaagcaaatgattgccctgatatgacagattcaagctatcaatggctccgaaacttgccggaccgacagctccattacgacacaaaccgagaatattgccattcttatcaaatgaagtgacctgttcgtcataacagttcaggttgccggtcaaattttctccttcaccatagcaggcatcagtcatcctgttcatgctgtcataggcaaaacgataacctttactgatgccgtccgtatcatcttcctcactccgccatgctaggctacttatattgccattataacaggggatgccaggacttgcattataagaaatttcttcagaaagaaaaaagcggcacatcgtttttattacctggtcacggacgtcatacgtatacattgtataggcacccaatcctcccacatctttcaaaaacacccggcgggcattgtcatacgtgtagtaaagcaaatgattggctctatacgcattatcaacgcggtgatatacatccctaagttctccatctgccagatattcataggtatattcttccatgtgccgctttccgttcccaatctgataggtatgtaatctggcaaataactttccagtatatgtatatgaataaaagtctgtgtcatacccgcccaaatgattttgggaacgtccctgtattattctgcctttatagtcataatataaggcacttgtcaaatatcgctcatcatccagcacttttattttagtcccggtcagtctcccttgtgcggagataagggaggcttcgcgattgatatataaagaatcatactgcactttacctatcttctccagcccgaaagcgagttgggtgtccgttgtgaagttgtaatcatcatagtaattcacttgtaaaagagaagatagcgtataaggaaaatgctctacttcatacccggaatgaagcactccgtctttctccgaagtcgttcgataagcccttactatggaattatccaatgaaggaggatcattgaatgaacaaagtcctgttaatgcaagccttccctgattatcatagaatgtgaacgtccattcttttttctgtgactgatttccattctgtgacaatataaccctgtcggctttgtcataaacataacctattgcagcacagccaggtagtttcttcgaaatacagcgtccgaaactatcatacaagtattgatatgcgtacaaatcgagatttcctgccgatatttcatcattaatcatgggtgggagaacatagcgtattcttccgaagcggtcgaatacaaaataggtgtccgcttgttgattccctctacctagccgggtcagtagcgtacgcccctgtttgtcaacaaaggtgtaagtcggtttcccgtcttcatccgtggcctttgtcacctgcaattctcccgaccgataatctcctctgcgaatcagtgaatcgttatcatctataaaatagaacgaacaacgcaatgaatcagccggaatattcgtcagatattccatacgggcaggatgatctccccaagcatcccccactccatattgttctgtaatacgatttagaggggacgattcatagttagtttgcaaataacttcttttacctgcatcatgataatcccacaagacaccacccttcaaatcttcaggagacatgtaagaaaagctagtattcgtagagagccattgtttctctttccgtcctaaactatcatattctatcaggtgatggtgagccataatagcaccggcacggtctgctccataactttgtgcaaaatcgagctcacgtccaagtccgtcatagaatgttatttcatcatagtttttttcttcatcctctccaagtggtgttcgtacataaatgtaattatgttctcccggtatggaagccagggtgtcttttacggctgtcatggaaagatcatttgcagaaacaggtcctgaaagcagggctatggcaaatataaataatgatatatgatttttcatatttcttgttcttttaataggaatttacagaataccgataatcataagcctttatggttcgcccataattatctttttgtctattgagccgctgtaagaggtcatattcataataactgaccactccgcacggatccgttacagaggtaactccggtcatcggctgatacgtataggatgttatttgcgcctgtggcaaagaagctcttagacgcaccagtttcgcacgatccggtgtgccggcttgcatgaacggcacgaggtctcctcccatagctgttcggacttcactaatggtagctccctttatttccgctgccagatgcaaatagttgtagctccaaaggtaaaccgtcttaccctcgtttctgacaacatataaaggatgtcccaaagcatcataatcaatacaattgtacacttctctcaaagcgccctcacctaccctttcccaggcagaatagcaaggaaaaaaatgatcggatactccttttataggaacatattcatatttcacctgtttcagttgccggctggttccatcatcggaaatagaatattccttttcttcgacaatcggagaaagtatatgcttttgtaccatttgagtatatatatccgagctggactcacggatccttttataggtttgttttcttattcctccattggcactttctgaaattacttttatcaagccgtccggatcatattcataatcagtctgcgtacttatcggaaaagagggattgtcgtataaagtatcactctcgcttttcagcctgtaatcatacaaatagaccttgtatgagcaaccgtcggcataagttataaatgaggtcgggcaaatataatcaagagatgtcctcattgattttacgtaaaggtcggaagagcgttcataggtcagatacttgctcgattttaaaataccgcctgccgaatacagttcttcacaaagaagttttccccgttctaccgatctggaagcacaaggttcataaggcgttcggttcggaagtatgattgcttccggggcttcgtccatgtgtccattatcgaagttggtatatttagaacggataaaagaaccgtccggtcttttttcaatcacctcactgtagccgatatgatttccggaagaattgatacatgccggtagcacagactggctgctgaatcttcttattatacgttttacatctttatccgccccggtaccttctacctgataatcatcaaaatagtacttcacctgtcctcccagacaaccgcttgagattcttgctttttctttattaactaaataatcatccacataaaagtactctttttctactttttcaccactttccaatcctgtatcactatttattatcttctttattcttagtcctcccgctattttcggctggaatgtatcctcgtacccttcccatcgattcattttcacttgcttacaatactcgtgaggttcgaaaacgaaacgtgtatatcctcccgtgggatagtgcagccttttcaaaacgccaaatgtcaaaacatccgcattaggttcgcgagaatcgtaatgagtggcataattatcggtcatcaaacgattgttgtaaaatccccagtgatctacttttccggacagataagggggcaactgctccggaaagtcatactccatattaaaatttcgtccgtttgctccccatacaaattcagaaacagattgtaatatcaggcgctgtgaggcgttgtcattgtacgagaaacggtaatcccgaatccactttcctttcttatcttttatttccaggttactcaacttataccatttcaacttgtccaaacaattcggataattatcatccaaaggattatctgcaagaaaattcagaaaacgatattttggatttttgcgccataacatatattgagaagcataaatatcctgtgaatatctcaattccgtagtcacttcacgcgcaaaagttatttcacattcgggaaaagaaatacggttgagataaaccggagatataagacttccctgataactgtcttcaatggccgtatggctcgaagatgagcactccggagtcaagattccgccaccaaatgtaaaagaccccaaatcatcatacagtgaaataaacatttgattgataaaatcaccacgctcgtatgtgtaagttatttcctgaccgttagtcaggatgatttttgtcagataccaggctgtagctgtccaaaaatccgtagcttgctgaaaaaatccgatagaatattcaatggcattccgttctttaccaaagatatattgagtgccatcttcagtagtcaaagtaaaaccatcaaaagaaggcgaatatccggaatattgaaatgccgtattcgctttttcaaacggaacatccatccaattaccactaaaatccacttttacaggcctgtcacattgcacgatccatgttttgtcactattcaacataaattttccatggtaatccaaaaaattgaaatcgaactcgtccggctcaaaatctgctccaccatgactttgagctgtttctttgagatagtcttgcgtattccattgaggcgtatttaatgtttcggaatgaaaataatatcccatattcatcaaataggtatgatttttcacattacaatcatcaggcttgcccttcaccgttctggatacaactcctccggtatttaaattccaccccattcctacccatcccggatgttggtcaggacgtatcccggcggcatgataatggagagaaaacggcaatttaaaatctccgacaggaacttcatatataggaacggatatatccggcatacctgtaaattttgaaaccggaatctcaccataaagtcccaaggccgctacattaggactaggtaacgattgtgaggaagcaggaatctgcgcatacataatattgttgcctagtaaccccactaaaaaaataaagatatataatcttttcatatacaactcattattaattatttcattctaaataaaaaaacacaggccacacatcaactattatcaaattaacaacctgcaaaaggagctaaccaaacaactatttcgtgcgacctgtgatcacttttacagattcatcgcattaccgcccacaacgcccagcactgccgaagccaccgcaatgacgactttcagaatcatatcccaaagggatctcttgactgccataactttacacacctcctttccatacgctctttgaagaattaattacttttaatcactaattacatttaatgattagttactttcaatgatctatcacttcctgaaaactctcttaccttattttcctgttatcctactgaaaattagtcctctacgtgactggaagctccaaactccgctttcacctcaaagcacggacacgctttgatccattcttccggctcaatctccccgtttccgttgcggtcgggacttaaatcgcgatgaccgcacacccggctaccaggataagtctcaagtaattgatgaaccagcagcttgagtgccgcccgttgttccggtgtccgcgtgtctgccggagagccgtggccatccaaaccgccttcgtagcagatacctacactgttcaagttgaatcctttcacgtgcgcaccgatacgttcaatcggtcgggtgaggtgcactgttccgtctttgcgaatgtagtagtgataacctgttccgttaaacccacgccgccgatgttgagtttccagatcatccggggtgagcgaacggtcggcacgagtggcggaacagtggatcacgatcaaatcaatctttctcatcatagtgccactgtttttcttatcagttgtaagcattatctacactctatgaattaagctgccgggtccggagcttcaccgctaccgcctccactgcctccaccgacatcttctccaccaccttcatcaccgggatcttcaccatcggttttcttcttcttgggtgcgtcgagatccagaaactcgattttctcaccggcacgggtagacgtcagattaggacgaacactgctcgaaggacggaaattgatattgaccgttttgatgttcttcatcgtacactcatctttcgtgtccactccccgcgtggtagcggaaaggctgaatacaccaaaatcatggatattgacggatttaccgtcgaacagcgccgtacgcatcgcttctacgagattagtcagcacactctgaatgtcacccagcgacagggaacttttctctttcatcgtgtaagcaagtttatccaggtctacactctgtccctgcgtcacaagttgcggatgatacttcaccaccccatcaacctttctcgggtctttacgacccattcttttaaatggtattgccatgataaattaaaaattgagaattaataattgaaaaataaatattacaaaccgcagttaccgcaatcaatatcggaagagaggaacgagctctgtttctttttctttcgatacctcaaagatagcgtattataaggggatgaaatgacgtactttgtcttactttgacctagtttgtcttactttcattcagaatgtatttacttttattcagagtgattttatttgacttatatacttggacaagcgggagattttccgtatatttggaatacgataaaattaattttccgaagatatgaaagcagaaaaagaagagatagcggaggagccgtttgtcatacgtccgtatttgaaatcggagctggcacatttatacaatccttatgtaccgttggtgtatgccatgcggaaaatgagggagtggatcagaaataacaaggaattatatgacgcaatgtatagcggcggcgaaggaaagaacgaccacgcttacagcgcaagacaggtacgactcatcgtgaggtatctcgatgagccatgaatctctttagggcaagtgctgattagctataacgaaaataaaattagctataatgaaatcgagattagctataatgaaatcagaattagctataatgaaatcagaattagctataatgaagcttatataataatgtacacgtgcgcgggcgcgagagaatattctttttatatagaaaaaagcgtgtaattgaggtggaggggttccacctcaattacacgctttttccatcaaataaaatctataaagagaataaacagcataagtaaatgacaggaacaaaataaaacgtacctttgcgtctttttaaaccaacattttttaacagtaatcaaataacacttaaaatcatgagaaaaaagacattttttccgaaggcttcgtttatcagaacaagcaggctgtaacactcgaaaaggaagagtttccccaagtatcccagtttatcacgcaaatgcttggcactgtcaacaatttgtatgtcaacagaatagaggtaagtccgcgcgaccgcaagaagtttctccttccctttgtccatctctgttatgaccatgactccccttttaagattaaaggtcccaaatactttgcagaattgttgtatctggctgttgatttcaagaaatcaaacgattcggacgaatcattaagcgtggaagagattgattgtgagatacaaagactgaaaagaacgctttttgacgattagcattaaagaaccgactgttaaaaaactgctttttgagtacaaaaagcagttttttttatctacaagaaaagccgtcctttgcagcgtgttaatattgacacaacttaaaatcatatcaacaattaaaatggaaaatatctcaataacgacatacaggggattatcactcgtatcaggaagtatcagtatccggcaaatgttcgaatttatccggggagatgtctatcgcgacagaatccggagactccgggaagcaatggatgcaggagacacggtgaaagcagaccacatgaagaagcaactgccctactgcaccatcacggctacttacgccaaggaaaggctggcttacagtctggacaagtatcaggacatcatcacgctcgactgtgacgatatgccggcagaaaagatcccggaattccgccaactggtgaacgattgccccgacacgttaggcagtttcgtcagcccacggatgcacgggctgaagatctttgtctacctcaccggcaatgaggcggaagccttacgcaccgaactgaacgcattgggaaccgtagacttcacccccctcgaacgctatcaccaccgcatgtacgccctggcaagcagccaatatgaaaagctgctcaataccaaagtagacaccagcgggagcgatccgggacgcggattcttcgtgtcgcacgatccggatgctttcctctctcccgaacgactggaaaacgtgaagccgctgaccgtaaaagtgacattgcccactgaagaagaatgtaaaaacaagaagcgcaaaaatccgggaaaacgatccccgctcctccccgtgcaggagaatgcgtcgcccatcgacctgcaagtgcaactcgacttccgcaaggcgctggagtacaccaaacgcaaagaacgtctcgagataggcaaccgggacaatttcttctattgtctcggcaatcagtgctaccaccgccatatcacggaagaggagtccgtcagtctggcacacagccatttcggcgacctacccgatttcgacctcgaactgcccttgcacaatgcttaccaatatacctcaaagaccgatcaggcggaagaaaaagagaaagaaccgaaaatctgccagattatcaagtttatggacgaacactacgaaaccagaagaaacgtagtgaaagaacaaatcgaattccggaagataatgcccgccctgcccgaaacagagttgccgcctttcaacgcagttcgtacaaaggatattaatacattctatatcaacgcacatataaataagatttgctgtacgcaagctgatttgaaagctgttgtagactcggactacgcaaagccgttcaacccgtttgtccattatttcacctcccgcaaggcatggaacgggaaaacggacttcatcggacaaatgacgaaaactgtacaagcggcagaccaagcttttttcgaagacagtttccgacgctggctggtgggaatggtagcgtgcgccatcgacgacaacgtgcaaaaccaccaattgatgctattacacggcgcacagggaaaaggaaagagtacctttatccgacatctcctcccgccggaactgaaggattattatcgtaatggcatgattattcccgagaacaataaccatttgctgcaactgtcgtcttgcctgctcatcaacttggatgaatttgacacgctctcccccgagcgtatgcagaacctgaaaagtcttatcacccaagacgtggtaaacgagcgtaaggtctatgacatccagaactatacgtatatccgccgcgcatcgttcattgccagtaccaacaatccgcactgtatgccggatgtcaaggaaaacaggcgtatcctgttcagcactcttctgaacatagactatcacacgcctgtcaatcatgaggggatatacgcacaggcatacgcactctaccggcagggatttcagtactggtatgagaacgaggagattacgtttctcaacaaccgcaatgaggcgttccgccaaaaagatccgatagaggagaatcttttcttctatttccgggcagccagacagaatgatattcaggcgcaatggtatcctgcctcctacctgctgtcggtattgagcatgaacgggcgcacacaggccaatacacagacgaaaaaaatgctggtcacggtactggaaagcaatcatttccaatcacgaaagacctccaacaacataacggaatattgggtggtggagtattcggccgaagagcgcaaagaaaattcaatacgcccgcagcttccggtgcagacggggttggagttgtagtttttccgcggatagcagttttcccacgaaatggcagttttcctccggatagtcgtttttgcacaaaatagcggataaacggataaattagtggcattaaacgtgtcacattcatccgtttttccgtatatttgcttcgatatgaatgatgaataaagaaaggaatcacaatatgataaagcaaataccatacggattgacggatttcggtcgcatccaaaaagaaaactattattatgtggataagacgatgtttatcgaaaagatagaaatgcaaccgtcttatctgttcctgatccgtccccggcgcttcgggaaaagtctgacgctggcgatgctggaggcttattatgacgttcggtatgccgaccagttcgacgaattgttcggccatctgtatatcgggcagcatcctacgccgatacataaccagtttctcatcatgagattcaatttctcggaggtgagctcgaatgtcaatgaggtggaggaatctttccgtttgcattgttgcgggaagctttctgattttgtttatagatacgagcatctgttgggaaaagacatttggaatgttctggatgaaaaaacgcaagcggatcccggcgcctttttgtcctcaatcaatacctatgctacccgtaagggagacctcaaaatctatctcctgattgatgaatacgataatttcacgaataccattctttctacttacggcacggacttatatcggaaagcgacacatggagaaggatatatccgcaggtttttcaatgtaatcaaagccgccacgacgggaatgggctctgccgtcaaccgcctattcatcacgggagtaagcccggtgacaatggatgacgtgacaagcggattcaacatcggaacgaatatcaccaccgacccatggtttaacgaccttgtaggtttcagcgagaaggaattgcgcgagatgctgacgtattacaaggaacaaggcgctctcccgatgtcggtagacgatgcggtgacaatgatgaagcctaactatgacaattattgcttcagtgaaaataaattagcagattgtatgttcaactcggacatggtgctctactgtatgaagtcattgatattgcacggagtgaaacctaaagagattgtagatcccaatatccgcacggactttaacaagcttgcctaccttgtccgtctcgaccatggactgggagaaaatttctccgtcatcaaggagattgcggagcaaggcgagatagtgactgagatagtcacccatttctccgcactggaaatgacagacgtgggcaacttcaaatctctgctgttctatttcggactgctttctatcaaaggggtggatatgatggggcgtcccatcctgcacattcccaatctggtggttcgcgaacagctattcaatttcctgattcagggatatgcccgtcatgacatcttcaagctcgacgtgaaccgcttgcgcactctgtttgagaatatgtccttcaaaggagactggaaaccgatgttcgaatttctggcagaggccattcgggagcagagccggataagggagtacatagaaggggaagctcatatcaaaggattcctcctcgcctatctaagtatgttccgctattatcaactatatccggaatatgagatgaataagggttttgccgatttcttctttaagcccagtccggcggcacccgtatctccaccgtacacgtatctattggaggtgaagtatgcgaaagcaggagcgtcggagaaagagatacgcgcgcttgccgatgatgcgcgggaacagttgattcgctatagcaaggatgaatgtgtagcggaagctcgtgagaaaggaggactgaaattgactacgatcgtgtggcgcagttgggaactggcgctgatggaggaggtagaatagactaccagccacatgaaatgtgcggatgaatcttataaatgaataaagaggacattcttaatagtatttttcaattcccccaaatccttttatcattttattttccttcgttttattgatgaagttgttcaatcgcttttcaaattcttccggtcgttttctggcagcttcaatgtatgcaattcggatacgtctatacgcatcggaaaattgttggtaattctcccatactgttttatcctctttcagttttccgatgatatcattcgggaagacaaaaggggctgacaatacttttcgtatattatcttccctatcagggtgaatcatattatgttccagcaaccatttcagtctctctttgttggcttgcgagtaggaacttttagggtttctgggtgtgaaatgctggattttatgttctttgtcgagcgcctttatggtgctgtcgatccatccgaagcaaagggcttcctcgacagcgtcgttgtatgtaacacttttttcgcccgaagatttggaggggaatacaaaccaaacgtcattggcgttttcaaagttgtctgccagccattttcgccaatcttctctgttttcaaaatattttatttccatagtgctaaaaagaacagcaacccattgttgagaataggttgctgttaaattggttattcatcagacttcatgtatgggagtcaggggcttttattcgtccggtcacttatttgtctccgtacatcttcgcccgcaattccttaatatggtcggaagtgatatattcgtcatattccatcatcttgtcgatgataccgttcggtgtcagttcgatgatgcggttggcaacggtctgaataaattcgtggtcatgagacgagaagaggatatttcctttgtacgtcttcaggttgttgttgaatgcctggatagattccaagtccagatggttggtcggagtgtccagaatgaggcagttggcattgcgcagctgcatacgggcaatcatacaacgcatcttctcacctccggagagtacgcttactttcttcaatacctcttcgccggagaaaagcatacggccgaggaagcctttcatatatacctcgttgccttctccaaactggctcaaccagtctaccaggttcaggtcggaattgaagaaatcagtgttatccagcggcaggtaagcagtggtgatggttaccccccagttgaaagtacctgcatcgggtttcatgtttccgttgataatttcgaagaaagcagtcatcgcgcgcggattgcgtgacaggaataccaccttgtcacctttctctacgttgaagttcacgtcgttgaagagcaccacgccttcttccgtcttcttgctcaatccggaaacttccagaatctggttgcccggctcgcgttcgggagtgaagatgatgcccggatacttacgtgaagaaggtttgatttcttctacgttcagtttctccaacatcttcttacggctcgttgtctgcttgctcttcgctacgttcgcgctgaaacggcggataaactcttcgagttctttcttcttctcttcagccttcgccttctggttctgttgctgacggagagccaattggctggattcgtaccagaaactatagttaccggcaaacatattgatttttccgtagtcgatgtctacggtgtgtgtacatacagagtcgaggaagtgacggtcgtggcttaccaccaatacggtatgctcgaagttggcaagatattcttccaaccaggtcactgtttccatatccaagtcattggtaggctcatcgagcaagaggttgtccggatttccgtacaatgcctgcgccagcatgacacgcactttttccttaccactcaattcacccatcaatacgtaatgcttatcttctttcacgcccagtccgctcaacagcatggctgcgtcgctttccgcattccatccgtccaactcggcaaatttttcttccaattcggatactttcagtccgtcttcgtctgtgaaatcttcttttgcatacaattcttcgcgctgcttcatgatgtcccacaacacggtatgtcccatcatgacggtatccatgacagtatatgagtcccacttgaagtggtcctgactcaacaccgagagacgttcgcccggtccgagcgcaatcgtacctgttgtcgggtccaaatctccgtaaatcgtacgaagaaacgtagattttcccgcaccgttcgcaccgataataccataacaattaccactcgtaaacttcaggtttacgtcattaaataacactcttttaccaaactgaaccgatacgttcgaaactgtaatcatcttattatttactattttactagttactatttactatttgagcgtgcaaaggtagacatttaaaatgaattatgagctatctgatatgtgccaatctgacataaaagtgttacctttgctgcgttttttggcaaaacggccaacttggcaaagtttttgcagacgaaatctgtgacatccggtcagtccggtatgtttataagcggtatcttgcatagataacgtgtgtttctaaatagtaaataataaaatagtaaataccaagatggatccgaaagaaaaaaaagtgaaggaagaggaactgaatgtggaggaaactcacaatcctgcggaagaccaaccgcaaaacgaacaagcagagggaaccgctccgctgactcatgaagaggagttggaaaaggaactggaaaaggctcaagaagcgcttgaagagcaaaaggataaatatctgcgcctgtctgccgagttcgacaattatcgtaaacgcactttaaaggagaaggccgaactgatcctgaatggtggcgaaaagagtcttggcagtattcttccggtagtggacgatttcgaacgtgccatcaagacgatggaaacggcaacggatgtcaatgccgtaaaagaaggggtggaactgatttacaataaatttatggctgttctggctcaaaatggtgtgaaagtcatcgagacgaaagaccaaccgctggatactgatttccatgaagccatcgcggtaatccccgcaccgtcggaagcacagaaaggtaagattctggattgtgtgcagacggggtatacactgaacgacaaagtgttgcgccacgccaaagtggtagtaggggaataaggattcgcgacccataaaactcataatttttaaagaagcatggcagaaaaaagagactattacgaaatattggaggtgacgaagacagccacagtagaggagattaagaaagcgtaccgtaagaaagcaatccagtatcaccctgacaagaatccgggggataaggaggcggaagagaaatttaaggaggcggccgaggcttatgacgtgttgagtaacccggaaaagcgttcgcgttacgatcagttcggtcatgcgggagtgagcggtgcggcaggcaatggcggtccgttcggtggtttcggtggcgaggggatgtcgatggatgacattttctctatgtttggcgacatcttcggtggccgcggcggcggtttcaggggaggcttcggagggtttagcggatttggcggtggcggttcacagcaacgccggtatcgcggcagtgaccttcgtgtgaaagtgaagctgacgttgaaggagatctctaccggagtagaaaagaaatttaaactcaaaaaatatgtgccgtgtgaccagtgtcatggcacgggtgccgaaggtgacggcggttcggagacttgtcctacttgtaagggtagcggctccgtgatccgtaaccagcagactattctgggcactatgcagactcgcgtcacttgttctacttgtggcggtgagggtaagattatcaagaacaaatgtaagaagtgtggtggcgacggaatcatttacggtgaagaagtggtgtcggtgaaaatccctgccggagtggcagagggtatgcagctttctatggggggcaaaggaaatgccggcaaacacaacggtgtggcaggcgacttgctgattctcgtagaggaagaaccgcatcaggacttgattcgcgacgagaatgatttgatttataatctgttgcttagtttcccgactgctgctctgggcggagccgtggaaattccgactatcgacggcaaagtgaaagtgaagattgattcgggtactcaaccgggtaaggtgcttcgtttgcgcggcaagggattgccgaatgtgaacgggtacggaacgggggatttactcgtcaacatcagtatctatgtgccggaagcgctcaataaagaggaaaagagcacgctcgaaaagatggaggcttcggacaacttcaaacctaacacgtcggtgaaggagaagattttcaagaagttcaagagtttcttcgattaattttttgctataatatataaggtataagtgagctgcaatcttttttgtggctcacttctgtttttagggcttgtccttttaaaaaaaagacatatatttgtgtagcaaataaatagatactaaatatagacttcaagtatggcagaaccttttaagaatatgtacaacaagcaatttttcgatctgtttacgaaagatttgagacttgttatcgatgattttgatgctcacggttttgtttctcaaataatggatgatgaatgggaaggcagggaactaaaacagcgctggatacatatcactagcattctgaaaaagtttttgccggcagattacaaagaggcgatcgctaagattcttgagttgttggatcatgtaaaaagtacgcggtctgatttttcggtgatagacgatacgaagtttggattgatgctggagtatggggtgattctgaataattatgtcgagcaatatgggttggatgattatgaaacgtctgtcaaggcgatagagaaaatcacacagttcacaagttgcgaatttgtgactcatccttttataataaaatatccggatgaaatgatgaagcagatgttggtttggtcgaaacatgggcattggggagtcaggcggcttgcgtcagaaggttgtcgtccgcgtttaccttgggcgatggctttgccgaatcttaaaaaagatccgacacctattattcctattttggagaatcttaaaaatgatccggcaagatttgtacggttgagcgttgccaataatttgaatgatattgcgaaagataatccggaaatagtcattgatttggcaaagaaatggaagggagaatcaaaagaggtagattggattattaaacacggttgccggacgctcttaaaacaagggattccggaggtgatggagttgtttggctttgattctatcagaaataatattagtgtggaggattttcagatttcaagtcctaaggttaaagtcggggattcgttggagtttggttttaacttgttgaatcatagcaataagacaatcaaaatacggcttgaatatggtatttattaccaaaaagcaaatggaacgctgacgaagaaagttcataaaatcagcgaaaaagaatatgccgggaattctaccacacgaataacgcgaaagcactctttccgtgtggttacaacgagaaaattccatctcgggcttcatcaaattgctataataatcaatgggagtgaatttgaaaaatatgatttcgatttgattgggtaattcgatttaactgagttattcgactggatcgagtaataaccacactacatataatatggatttctgcattagctattatctctacaagtgctgcaacaaataatataaatcctcgattctccggatgaaaatcgaggatttttttattttgattactactatcttcttcctaataccccggattctgtttcaacctctcattcatcacccgtattttctccggtatagggaatacagttgtatatccacttgcctcatccggtagttgcggacggctgctgtaagctcttgtaaacttcccgaagcggactaagtcctgacgtctccatccttcccaagccagttccagctgacgttcggcaaggatattctctaaagtggcagtgcgaggagaagcgttgacacggctacgaacttcattgagttcttcatctccgtttgctccgttccggactttcgcttcactcttcatcaacaaagcgtctgcatagcggaacaatacaatgtcattctccatcaacttaccgtcttttgtggcagtcgggtcgacttcatactttttcatgcgggctcctgcggtttgttcgtatggggtgtctgttatatccagagatactttccagggcagatattccagtaccgttccattatccagtttgattatgtttcctttcaggtcgtggacaattcctgcaaaatagcaaatatcaaaacggggatcttgttccgcggtttcataaccgaaagcttcgagggcttcaatggtggcgctgggaccgttctcaccgcttagtccgtaagccttggcgtgattatagtggcgggaacggaagagatattgcatctggttggtgtacagagttttgttcatcgggatagtgaagacattctctacggacggttcgttgaatatagagaaattcgtttcgtattccggttccagtttgtagcccatagtcttgagttggtcacaatagtagatgactgtttcccaggcattgagttcgctgccgttcactgtgaactttatattttttccatccgggcgttgtccgtccgtccaatcattgtctgtataaacttcggagttcaaagccagtttggccagtaggaaagttaccacggggcgagtgatacggccatagtaagggccggactggttgctatgtgcatcgctcaacaaaggagccgcctcttgcaattccttgacaacaaagtcaaagaccgttttccgttcactttgcactacatctttcattgctacggaagaggattgaactagcgggatgcgtccgaacaaatccatcaggtaataataatacatagcccgcatggcacgtacttcggcacggtatgccggcagttccgtagcggaatgagtttcggcgaatttgtctatccgttccagtgatttgttacttaacatgacgactttatagagatattcccatgtagcctgaatggcatcattctctattccccaatcgtgcaggtaaagtccttgccaaaaaccaccgtcataccagtcacctccacgggtggggataatggcttcgtcggaggtaaaggtgttcaggtcgtagactcccctacccgttccctgcaatccctgactatcactataaccgcctacgtatgtataaagcgaagctactgcattgagatatacttccgagattgtattgtaaacgtcatcttcgggtaacttatctttcggattttcctccaaaaacttactacatgagaataaacccaggcacgttataagaaggaataccagcactcccgaaggacgtaagatcttctttgaaaacagttccgctatccttgaaagcagttcttctttctgcaaaaaaagacttttatttttcatatattgtttcatcatctcctcctccattaaaagttaatactcaatcccagtgtgtacgtccgcgccaacggatatccccgtttatcatccacgcctaaagtggagttcaccgttgaactgttaatcatgggtgaaagtcccgaataaccggaaatggttgccaggttgttgactgtaaatgccagacgcagggaacggacatatttcttcagtttctgcactttctcaatcggcacgttccaacccagcgtcacatagtcgaagttgacataatctcccttttccaaccaatagtcggtggcggtttgatccttgatgttctgtttcggggctttcttcattacgttatagtcgggaaatatattcatgttcatataggtcagggaggttccgttgtaaattttatgtccgaaagctccgttaacctgcaaagacaggtcgaaacgcttgtagcggaaactgatgttggagccaagaatcgttttaggtacggcttgtcctgctacgtagcggtcttcaccatcttcaaggctgacacctccgccattcagatcggcgatgccataggtgtatccgccgtttccgtcggattccagtcccgtactgtggggaagatagaacacgcccaacggttgacccaccatctgatatacgatgtggttgtatcctccatgaaagccggctccgtcgaggccagaaagacttttatattcgggagcagaaagcatttcgccgttgtacataccgcttaatgagagcagtttgttgcgctggaaagtgatattggcattgatattcagttccatatccttggtcttcaagggggtgatgccgatggcgatttccgtaccccagttgcgcatggaaccgatgttggcaagcaaggtgttataggtgaaaggcggtacgcttacgttgtaaaggtaaagcatgtctgtggttcgggagttgtaatagttggcggaaagcagcaggcggttgccgaaaagagctacgtcgataccggtattaaaggtatgtttcacttcccatttcaggtcgggattcgtgttccgcaagtctcctaaagatacgacggcggagtttccgacggggactacaccgttcggctttacaaggttcaatgtagtgtatgagtcaatcccactctgattacctgccagaccgtagccaatacggaatttcagattatccaccatcggcaactgcttcataaattcttcttcactaatcacccatgcggcagatgcggaggggaagaatccccatttatggttcgctccgaatttggaggaagcatctgtacgggcgttcagcgtcagtacgtagcggtcggcgtatgtatagttgaaacgtcccatgaaagatgccagacggggttggtcgtagtaagaattagtgccttcccacaagcggagtgcacctgcctgaagattattatacccgaatttgtcggtgctgaaattgcttactgttgtataatatcccgtgtaggtttctttttgaagttcggcaagtgccaacacgtcaaagaaatgttttttccagtttttcttataggtcagcatcatgttgcccagcaaggattctcgctttttggttcctttgtaagcctggccgttcgcccagacggaggtggggaggtattgcgaattttccacgatattataggtataggctccgaagaggtttagtttcagtccttccagcagattgaaagtcagacgggcgtgcgtgctgatgtgcgaagtggcatcatcatcctgcacttccatccatgccaatggattggtaatttggctggcagtcgttattccgtcccaggaattggtgacggggtctttatggttgggataggtggggttgaatgtggctgccgaatagaacgttttctgataatccaccagattatgattcttctgaatggaaccgaacattcccagctcgcagttcaggaagccgtcgaacattttctgattcatgttcatattcgaagtgaagtttttcatgtcttcattcaaaatcactccctgacgatccatgaaaccaagagaaacgcgatagctggactcactggaaccaccataaaaggcgatgtgatggttttgttgtagtcctgtctgttcaatctctttctgaaaatcggtattatatcctttgtccagaatggaaatcccgcgttccgaagcgatacggcggtactcatcgccggacagcattttcagattcttgtagacggtggaaattccgaagctaccgttgtaggctacctgtgttctgccgctcattccttttttagtggtgacttcgatcacaccggaagctcctcgtgaaccgtattgtgcggtttcggaagcgtctttcaaaatggtgaagctctcaatatccgtagggtaaatggaggtgagcatactcaagtcgccaaatactccgtcgacgattatcaaagggtcattgccactggtcagtgaggtagttccccgcaggcgtactgcatccaaggctgccggaccatttgacccgcgttggatggtcaagcccggcacacgtccgcggattgcttccaaagggttcgttatctggtctttattcatctgtgtctccgtaatcttctctacggaaccggagagggttttcaaacttccggtggcatatccaacagttatcaatgagtctatgggcgtgacggggatcttctgcgccaaggtgctctcgcacgggattaccagaagaagaaggctgtagaaaatgagtctagcgtgttgtaccatattcttagtttttaaggtaataatacaaatataacaataaaagagggaatctggttgagtagattccctcttttattcataaatgatattgacaatgtctatttcacgattatctcatccgtaaatatccaacctccgaattcgcttccggcctgtgcctggtaacgtacgtatcttccttttgcttctccctgccatgaaatatccgtaaaacggatgggtgtttctttacttacttcaaagtgttgtttttgcagctccgtgaagtttattccatcatcggaaatggaaataatcactgtctccggcaggaatacttccgcgccgaccacttgcataaaagcggcggtaacggaatggataggggtttctttttccatatcaatcgtcacatcgagacggttgtccgagataaatccttgccatgaaccatcaccgtaagtccagtcaccacgtatgccgtctgtcagggctgtgttgccttgtgcgggataatgggggctataggaggagttataggtcacttttttaccgagcgccaaatggctgactggttgaagagattcgggacggctgccgatttctttgctcaaatcgaaaggatggtatccttttttctgtaaatcggccactgctgacagtgcgcgggtatggaaatcgggccacgacttacgttccggagccgaccaggctacttccgccaatgccagcatacggggataaatcatatattccacgtgttcgggagtggggatatattccacccataggttaccctgcacaccatagactaactttgcctgctccgcagttaaggaagcggggacaggatcgtaggcatatactttcttcaatggcaggtagccaccgatagcttccggctgggagtacggggcgtcctgatagctgtccagataacagtatgcacccggtgtcatgatggcatgatggccggaggtgacggcagcaataccaccctcttctccacgccacgacataacggttgcattgggcgcgatacctccttgcagaatctcgtcccatcccaagagacggcgtccgtgattgttgaggaacttttcgatacggtgtatcagatagctttgcagctcgtctacattggccagatgctcgtctttcattctcttctgacatttcggacaggtcttccaagccgatttgccggcctcatcacctcctacatgaatgtattcggaagggaaaagttccatgacttccgtcagtacattctccagaaaggtgaaagtttcttcattaccgacacagaaatcggagttcttgtaaggttctcccgaacaggatagctgcgggtaggcagccagcacttcttccgaatgggaaggcatttcaatctccggaatcaccgtgatgtaatgctgacgggcatattccagtatttcacgaatatcgtcctgggtgtaatagccgccggaagctccgggttcatcgtaacggaggtatttacgtccgccgttccaccatttcttccaggtggggtctgtacgccaggctgcaaaatcggtcagtaaagggtatttcttgatttcaagccgccagcctgccgcatcggtcaggtgcaggtgcaaacggttgattttgtaatatgccaatgcgtctatctgcttctttataaactctttggtagagaaatgacgggatacgtccagcatcagtccgcgataagcaaaacgaggggtgtcttctatctcgacagagggtacggaatagctgcctgtgcttgccggttgcatcagctgtaacagggtttgcattccatagaataatccggctcccgaagttgcccggatctcgattcgttgagaggtgacggagagtgtatagctttccggtgacggcaactgggtagtcttgggggttatcaataagaaaagcatctgtttcctgtctttctttctcgcttcctttaattgaacgggtaatgccttcaggtatttctcccagagcttcgcttctccaccttgtaggtttgtataaagtcttgtcttttctgacagtaaaaaagagcccgtccccttctccatttttaatgggacaggtatgacggactgtgccagaatgggatgtgcatgaaagcacatccccagtatacataagaaaagacaaactttagtgtattcttttcttatattcattaatcaattttgatttcgtctacaaataaaaatgcgtttttgccttttccaccatgccattccggaagcgttttctccggtgaagcaataactctcacgtattgggtagtcacaggagcaaatgtaagttgatggtcaacaactccgtctttgtccgtctctttcattgccggatattcttcggaagcaatctttttgaaagtctttccgtcatctgaaacttctacggacaggtttctggcgtcaaacacccagtcgccctttgcaatattgacagagatggccacactcgaaatttcagtaggttgctgaaggtcgatcgtcatgtccatgtcgtttccgttgaaagcaatccagcggcctgaccggtaactactatttcctttcaaaccatcggttaacgtggaagctcctttgaagaggtattgttcattgataggttgattggctacaatcggcttcatgctggatttgctgaagtcaatcttctctgtcagtgtctggctctcgccggtaggacgaatggctttggcggacagagtggcattttctttaattttcaacactccttcgtaaacgggagaagcagtagtgggttctgtgccgtccaaagtgtagtggacaggggcattgtcgatagtagacaaagtaacgtccatcgttccttctgccggattcggttcaaactcggcttgtacgccgaacgcgtgtttagcgtagttgtatccttcggcatcataccacttaatcagttgaggaagacgagacaggaagtcggcatagtttttcttttcagggctggaccactgaatttcacacaatgcagcccaacgaggcaataccatgtactgcgcgtgagggaaagtagcgatgtattctgtccagaggttggcttgcacacccttgatatatttctgttcttccggagtgagggaagccggcatcggctcgtagctgtacactctttctaacggcaggtaaccaccgataccaaacggttcgttatctacgtctttagcttggtaatagtcgaaatacaggtatgtgttcggcgtcatgatgacatcgtgtttctgtttcgcagcttcgataccgcccttttcaccacgccatgacataacagtagcgttaggagcaagtccgccttcaaggatttcatcccaaccgatgatctgacgtccgtggtcgttgaggaatttctcgatatggttgattacgaaactctgcagacgttcttccttgctatgcttatcatccgatttcaagcccagcgccttgatacgtgcctgacatttcggacatttttcccaacgtactttcggacattcgtcaccacctacatgaatatattctgaagggaagattgctattaattcagtaaacacatcttcgaggaatttcaagacttgatcgtttccggcacaaagcacatcttctgatacaccccattgtctccatacttcgtacgggccaccggtacatcccaattcgggataagcggcaagggcagcttgcatgtgtcccggaagatcgatttcgggaataactgtgatataacgttcggcagcataagctactatttctttcgcctgttcctgggtatagaagccaccgtaaggtttgccgtcgtattcaccggagttacgtccgatgactgtttctgtcctcttggaaccgatttctgtcagcttcggatatttcttgatttccagacgccagccctggtcttcggtaatatgccagtgaaaacggttcatattgtgcaaagccatcatatcgatataagttttcacttcatctactgtaaagaaatgacggctggtatcgaagtgtgcaccacgatagccaaagcggggagcgtcattgatttctacagcgggcatggaaatgtctgcgccgacagccacaggcaatgatttgcgcagggactggatgccatagaatacgccggcttccgtaggaccggtaatcgtgattccgtcaccggtaactttcatctggtaggattccggattttcgttctccgtgcctaatgccagtacgattgcgtttttaccttctgttccggcttcaatagcgaaatcttttccggtagccgttttcagatagtctgccaggaattttgcgttgcgttgcatcttctcgtttccttccggatagagaattttcacactgctcttgaggatgaagggacttccttgagcggttacaatttcttgtggcatggggatgatctggtagttggcttcctgttgcgccgattggcaagaggcaaaaagtcctgctagtgccagacatccggttaatttaaagagttgcttcataaactaaaaaattaagtgttaagttattaatagattaattataagtttcacgaatatgtttgattgtcaaaggcagctcctctcctttctttatttggggagaagtgatgacgaccgttttacgttctccgggaagaaggtcgaaaaagttgtcgctgaaacgggctccctgcaaaggaatttcaataaagacatcttttgcaagagcgggagaaaacaatgtcagttcacacatgccgtctttctgtttcatcttgcaggaaacggttgtttcaggcagaagcaggtcttttgtttttctaaagaagtatacggtttcggcaagggtgtttcctgccttgtcttttagcgtcagttgcatgaaacagcgttgctgttcttccggtgatagccaggtgtcgggttttatacggtacacgcattgggaagtgttagccggaactgtcaatgtgttgagttgtataggcttgccttgtttctttccgtcaaagtctgttactttcatttccaacatcaggtggtctttggtgtccggacagtcggaaatcaggtagatattgaggctgtcgttctgctggataggattgatgaggattggagcaaagactcgtttggcttggtaatgcagggctttccagttaccgtaatagtcgatgctcgaccaggatactaccggccagctgtcattcagttgccaatacagggtacccatacagtaaggacggttccggcggtgtgcttccagtccgtgacgcattccttgtccttgcagtactagtccgacatagacaaagtcttcaaatttttcggggatgatatagtcgcgctccatgtaggtacgaatcagggcgttgccgatgctgcttttctgatgagcattcatcacttccgattctatctgataatcttccggagcggcgaaagtggagatggtcttcatttccgggaaggactgaaaaccgaattcgctcatgaaacggggcaggtctgtatcgagtgactcgaatgttttttgaccataccagactccccagttatggctgtctcctatcccccaggattcaggacgcccccagttggcaaaatacggggagctgtgtatgtagaaacggtcggcatccagttccttaaccttggctggaaggagctgatggaacagtttgtcgtagcctcgaaacatttcctgatagatttcgggcgggaagttcttgtcgaatccccaatattttaaggcttccagtatttcgttattgccgcaccacatcgccagggaagcatgattgcgaaggcgacggatgttatagcaggcttccgcctctacccttttcagaaaggtggggtcggacggatagggagtgcaggcaaacatgaagtcttgccacaccagtattccgttttcatctgccaggtcatagaaacggtcatcttcgtacgttccacctccccatacacgaatgacattcatgttcgcttcgcggatgtcgcggaataaggtttggtagcgttcggtagtgacgttagtcaagagtgcatcctgggggatgtaattggctcctttggcaaacataggtacaccatttacttcaaaatagaaggattctccgtctttatctttttcattaacgaggcgaacagtacgcagtcctatccggtgcgattgctcggctacgactttatcttctactatgatttgagcggagaaatcatacagggcgggctttccccatccattcggcatccaacgtacgggggatgccacttcggaaggtatggaaacatgattgattccgggctgtaaggtgattgcctggctgatgcttttttctgcacttccttcgaatgaggtatttattctcacctctgcctgaagtggccgggagagtatgttgtttatttctaattcattagacagatttgcgagctggtcggtcagtgcgagttgctttacgtgatagtcactgatagaagctgcgtcataaaaacggatggtcaccggacgccagatgccgctggtcaccatgcggattccccagtcccagccataactgtaaggggctttacgggagaatatgcttaaatgtttgtcgtgatggtcgttgtctgccggatagttgaatccgttcgagttatattgaggcagtgtctgccggatgggggaatgaaaatagatgtgaagaaggttttctccgatacggagttgggacttgacaggtatggtataaccgacaaacatgttatcggctttcagcaacaatgctccattgaggtatacatcggcgtatgtgtcaagaccttcaaaaaccaattgggcgtcatcccgtttcagttgttcgggggtaactgtaaaagcagtccggtattcccagtcttcattttccacccactgaatcttttgttcattgatgccataaaaaggatcgggaagttgtttatggttgataagatcctgatgaacggtgcccggaacctgtgccggtcgccacagctccgtccctgcctgggaaaactcccagcctgtatttagaacgacaacttcggaattgtcattgctctgtgcatatgccatactgcaacagcatagtagttcacatgctatttgagccttttttccgatcaaattaatcatcatagtgggggcattagatattaacggattcaaagatattattttttcagcaaatttcactgataatttaacaaaatatgttgtttttgcacgccacgataaatatacggttttattcttttatcatatcggatagtttaaccgctattatatctatcatttcattcctaacaaatctgttaatttcaccgcctgaaaagtcatgtgtgccacactgctctcatatagaataccgattgtctctttatcaatcatcgtcaggcaactatatccccatccttctgcttcgtcgagcatgatttgatgttcgggcaaccaggtaagtcctttatccagacttgcttttattgttatatgattgcgccctttagttgtatccggatttgaaaacaacaggaggtctttattcaaaatgttgtccttggcatcgacatgaatcagactggccatacataccggttcctgaagtgccttacgtgaagacggatgttctgtccaggtttttcccaaatctttggttagggcgacagcacggcttcctcctctattatcacgcatattcagcattaatactcccggttctatttcagcaacttgtgcttccgttgtattagtccgtgccagatgatgcattttccatgtttttccccggtctttactatacatgattcctgcattcgggatacgggtagagtcgataaactgtgttggaaatactaatgtaccgtcgctcatcgttattcctcgtcctggaccttgaagcagaaaataccaggacggatcttttacctgctctgttatattgatcggtttcgaccatgttttaccatcgtctgtgctctttgccaataccagctgtgcggtatggtttatatccattcccggatgggagctccaccaggcacgttgattacccataccatgtgtccatgcggcaaccacccagacggtattcgtttgagtatctaccaaaatagagggatctcctaccccattctgtgctttaggcaaaccgccatactcaccaaatgaaagcggaagacgcattttctcccagctcttccctccgtcagtgctacgactcaaacccacatctacatattcctgtaaatcgacactactattatatcggacatcgtacactcccaataatgttcctttattggttgtcactaatccgggaatacggaaggaagcagaaccgtcattaccagcatgacgaactccgactgccatccggtgagtaatagctttcggagaaataaatttacaataaagttctttcccatccacttttacagcacgtaaatcagagactattttagtatgcaaagaggcatctgtttttatctgcaaactgatccaaaaaaagttgacacctggaaataaattgtaattacctcttaatacaactttttccgatggtccgacctctgcacattttatggaataggaaggattagccgccaatgtcgcacccggtcgatggctggatatgtactctacaggggcaaagcgatttttgttttgatcttgtaaggcctctgttcctccataatagagtttgattgcctgaacatccgctaagttggtacttttactgaaatctaaaacaacttcatcgagtatcttgctttcctttgcatccaaccggatatagaacagaacattatcctgccgctctatcaaaaccgggatttgtgtttcatggataaatactgtgtctgaagcttttacgtcaaaagaatagcctaataagacaaggaaaagtaaataaaaaattcttctcataatgggggggtattagttagtttaacgcgataaagataaaacttttctaccataatacagctatgcaaacagttaactttcattttaccaagttctggtaggactagtcaatactttgaccaccattctggctcttgtgtatgcagtagagttctgtggttacttccctactgataatcccaagtatagtattattgtatctattaataagactggattacctgcaagtggtgaactaatggcaggtgatgctttcaggcaatttgttgataaaataatggaaaaataatcatggatggtataattgaatttgatttaatcaagaatcaggcttccaacattataaaagtaataggtgtaggtggtggcggtggaaatgctgtaaagaatatgtacagtcaaggcattaaagatgtttcttttgctatatgcaatacggatagtcaagccctaagccgttccaatgtacctactaaaatacagttaggagacactggtctaggagcaggtggtaatcctgaaaaaggacgtgcagcagcagaaacaagcattgagcagataaaagctctttttaatgatactactcaaatggtatttattacagcgggaatgggtggtggaacgggtactggagcagcacccataatagctcatattgcaaaagaaatgggaatattaacgataggaatagttacaatcccgtttcaatttgaaatgaagcctaaaatagtaaaagctattaagggggttaatgagatgaaagaaaacgtggatgcgttgttggttatcaacaatgaacgtttgagagaaatatacgctgatggaatcactacagctaaagaagcgttctgtaaagctgatgatattctaacaactgcaaccaaaagtattgcagaaataatcaccattgaaggaactataaacagggacttctgcgatgttgaaaccataatgaaagatggtggaagtgcaattatggcaatgggtagagccaagggaaaatatagaatacaaaatgcaatattggatgctctcaattctcctttattgaatgataatgatatagaaaaagcacaaaagctattatatattatctattccagtaaagagaatcctattcttatcaatgaattgtctgaattgaatacattcatggaggaattagacccaaacattgaagttatttggggactatatgacgatgatagtttaggagaggatgtgaagattacactaattgcaacaggttttgataacaagaaagattctgtgaacgctgaaattagcgatgatgtaagacttaaatctgaaattgagaaatattacaaacctactcctgaaccattgagtaaacaagtccaatcagctattgttgaatcaaataatgatacaaaagaagagataacagagacgcaagagcctattacatttgaagagacgacatctcattctacaaaagaaaaacttattactcgtcttagtaatataataagtaaattgatggaagatgaatagcatagtagtgttttcaagaaactgtttatcgcataatttctaaacaaatagaatatggaaggttggatagttttaggcttaatactaatagttatcgcctattttttggcaggattggattatgaaggaggtctgtaaatgatgaaagggaataaactttttttagttgtgacagatttatgtagcaatgccttaccgcttactttgcctacaatcatcttcaatttcaataatactggagttgtaagagggtgtatcatattactgccatctaaatttgaaggacgaaaacaaatagaattagctaatgagcgcatgagtgttctgtctccattatttgactttcttattgtggttaatcctcaaaaactttcccgtgaatttgtaaagatacataatattaacgggtttgaagctttttatgatgaattatggaaagaagttgcaactcttacagctatcgttcattcttccaagagtttggatgaagttaggagaaattgggagaaagataaatcatcaaaagcactattgcagggtggagctttatatatcattagagataaggatattgatttcactattgataaaaaaactttgcttttaggtgtaggtgatgctggtactggagtggcagaagaagttcatttattaggtttaaacaatatgacggtggttcgattgggaattggcggtgtgagatgttggggaaatagctatagattagatttagcgggagattggaattattgtaatgggattgataaaaggtatcattcttgtatcgaatttgtgaagaaaaacataaacgtaatcaaatatgatatagagtactttttaggattcgatgtttcttgccaatcagatatacaaattaaagaacttgaaaaatatagtaaacacggtcattaatgaacacagtagtatgataaaattcagccaaataccatattctacatattcctatgatggaatgcccaaaccaacatgggtaaaagctacttgtcccccaaacggtattcctcataatttcagcttatctgatgatgatatgctgacctattatcttgaaatatttagaaatagaacagctaaggataagccatatatagaccaatataactctatagaagaattggaagaagatatatatggtaactgtttatactattggattcctaaagattttaaggaaatatattgtgctcttgataaacaaaatttttttcataaaataaatgtattgataaagcaatatggtaatgccattgtaataaaacatcgtgctttatgtataaaaacagatgaaagtataaatctatattctttttataaaggtttatgcccagataaagatatattgtctatatgtattccaatacgaatatttgaattaggactgtgggaggaagggagcttaatgtatatgactaacgaagattattataatttatcaaaagaaattctagtcaaacatgaagcaggagaattaacggaaaaccaaatagaagaaataataggttctgtaatcataaaagaatggataattgacataaaaccaacccaatagaatacttaaaaagagattatatcatagaaggacttaccaattgttgtgtggaatacgatgagaatggtgaggagatatttataattgaaaaaactaaatgaacaaatatgataacagcagaacattggatggaagggattaattctgtactagatgagtacggactatcaagagaggagttttggaaagaccctaaggcgttccttgacaatttagatgatatggacgcaaagcttacactggagtattttatggaagtagtataaattggacaataaggattcttaatattatcatcaaaatgtgattcatttgcaataatccccattttaaacaagaacttatgaaaacaagaaataaactattaaagtatttagatacaagttgggaaatgttagcgaataatgaaaagccacctattattgatttatctgaatttaatatgttttcattttatattcaaatatttaccaacaggaatgaaagaaaagcaccatttattgggaagtactattcatcagaagaattggaagaagatatatatggtaactgtttattcatgcaccaaggatggaaatcaatggattttaagaaagtttattccatgttggacaaaggattatttattgaaaaaatgaacaatatgattaaagattatggtaatctcattattgatttaaataatcccaatgatttaagctataacatatatagtaccacaagaattgattgggataataaatctgatagtttttaagtaagtgatagtaaaggtttgattagtttcccctttattctatttgccataattggacatttgggaaatgtttaagaggttctataatctaggatatgacaagaaacgcagggtgtaactaagaaagataagtcaaaggttaaggtggtaagtgaaatttcatttactgccttattttttataatacagtggactggaatattggataaatttgtttctttgcagtcattgattttaaaagataataccatgaatgaatatgtagatttttatatgcagagatgcttgcaggtagccacaagcatagatgacaaaagcaaacatattatattgaacaatatcaaggctataaattatgaggaagctgtaaaactcgctaaaaccataatcatagatgataacaaacgaaaattattgctaagtgaagaagtctttgttaacgatagtactttagctcaatatttagaaagagaggaactggatgcgttaaaattatggagattatccgtattgctgtacgctatgataatgggatgtaatgttgctgaactatccatatctgtagcagaccaatatttagacttgttcaaccacctaaacgatggaatgaatgttgcaagtattgaagtagtgggtaggttgccaacagaaacgaaaaaaggtaaatcgtcaactaaaaccaaaaagtttactatctctagtcaactactgattaataaaatgaaacaagcttatttagaactgcaagatgatattgtaacagtagataacttgaagcattatacaattgagaggattaccactatgaatgaaatagcaaacaaaagaatcttgaattattattttgcacaagaattgaaagccttcttgagcaaatacaaaggtggaaaaatgtcctcaaacagaaagaagcttgttttatacatcctatacttgtttggtcgttttaagaacaatgttccaataaatacagataattatagagcattaatgcgcgactataataaatccccaataaaactttctctattcacagtaaacgggcagtcgttccccttaatcttactgcctaatccagaaattgaaaaaataaggtctaaatatagaaggttcatagaggaaatgtgaaatttcgagataatctgatttttcacgaaaagtaatttatggtttcttaccttcgcagcgttggcaatattgccaactgtattaaattatttttcaaccatgaataaaaatataatttctgtaaaagacctctatattggaggcaaaatgattgcttttattaaaggcaatcgtagtgttaattcaaagaacatttcaagaaagaaaaagtcctttgagaaatttggaatgaatcttgttcctttaatgtatgtagacggacaaaaagcggtaaatgacggctgtactttggtgcatcctattacgaaagaggatataccggatgaagaagcaagtaagtatgttgccattgttgagggacaacatagatatacggcagccgaagaaacaggtttagatgaagaaaagctgttcttgtatgaatgttacagcaatgagaacactaaagagattctctctgaaacaaacacaattactgacccgtggagtggtgcagattatgctaatggcgcggcactatttaatccccaaaatgagttggcaaaatttacaaaagaacttgccgatttaggttatccaaccactacgataggttatattgcttgttttgctcctggtaagttgggaaagacagcatactgtaatttgattgcaggtaaagaaataaaaacagattataatctggaacgtgctaaatactttttggatgcagcacgaactaaatttgacaattcctttatcgctaaaagatacctgattactgtagttgccgacctgtctacagaacatgggtataaacttgtttgtgacgctttaaaacaaatgccagatgctatagtaaaaagagtcctagaagctaaaagtgaagagaaacaaagtatcttgaaaatgaccttagaaagtctactcaataaataattagaatatagccagttgtcagtgatgatagctggcttttttatctctattacaagtgatgccaagaaattataatagtgaattacctagtcactgttgtgttggaaaaatgtcgtatagaatattctgataggataaatgttttattttaattgctttcttttcttaaataattggttgttatggctagaagatgtatttttgtagtggttgaaatgagatgttgtcacagaatttaataaccgattatgtaattgcttgataatcaatataggtaataaagatagcttgtttttattacttttgccgtattaacaagcgaaatatttccaaaaagatgcgcaaagtatactacatctataatccacagacccagacttatgatcgaatttaccctaccgtacggcagcgtgcgcttagtatcctgcgtcggcttttctatggaatggggttgggagcaggttgctttattgtattgcttttgatttttggttctccgtcggagaaggaattaagaattgaaaacagccgtcttttggcgcagtacaatgtgctttcccggcgtttggacgacgctatgggggtgcttcaggatattcagcaacgtgacgataatctgtatcgagtgattttacaggcagatcctgtttctccggctattcgtcaggcaggttatggcgggacgaaccgttacgaagaactgatggatttggcgaatgccaagctggtggtgaacacgactcaaaaattggacgtgctttccaaaaggctttatatccagtcgaaatctttcgatgatgtgattgatatgtgtaagaaccatgatgagatgctgaaatgtattccggccatacagcctatttcgaataaggatcttcgtcagacagcatccggttatggtacacgtatcgatcctatttatggtacgacaaagttccatgcaggcatggacttctctgctcatccgggaacggatgtatatgctaccggaaacggaacagtggtgaaagtgggatgggaaaccggatatggtaataccattgagatagatcatggcttcgggtatctcactcggtatgctcacttgcagggatttaatacgaaagtcggaaagaaagtggtacgtggtgagattatcggaaaagtgggtagtacaggaaaaagtaccggtccgcatctgcattatgaagtgcacgtgaaagggcaggtagtgaatccggtcaattattatttcatggatttgagtgccgaagattatgaaaagatgattcagttggcagccaatcatggtaaagtattcgattaaaatcttaaaacaggagtgttatgcttaatacagacaaagaattgaagctatattattcaataggggaggttgccgacatgttcggagtcaatccgtcattgctccgtttttgggaaaaggaatttccgcaaatctctcctaagacagcgggaagaggaatacgtcagtaccgcaaagaagacgtagaaacgatcggtcttatctatcatttggtaaaagaaaagggcatgacacttcccggtgcccggcaacgtttgaaggataataaagaagctacggttcgtaattatgagattgtaaataagctgaaagcgataaaagaagagcttttggctattaaacgcgaattggatggacgggaataaataaatgctaatcgatcatggattcgataggcaagaaacctcataacaaaatgaacggcgaacaatttgcatgatactgcaacttattcaccgttcatcgttttcttatttaccgtttgaaagctattcttctacacggctcacctgtttgatattctgtattttcttcagattgttgcagatggtttttacatcatctacatcatgtacccacaactgaatttttccttcaaagatgccatcttcggtttcgatggtcagcttacggatatttacattgagctgtctggagataacttgagtgacttcattcaaaagtcccatattatctataccttttatatatatatataccaggaaagacagttctttgtgtgtatcccattcggtcgctaatatgcggttgccatagctactcttcaatttggcagcaacagggcattggcgcttgtgaataatgatccggtcgttttcatccacatatcccaatacatcgtcaccgggaataggatggcaacattcggccatgatatatttcttctgcaaactttcttccgtcagtttgagcacctctttcgggttgattttttctttttcctgcggttctttctcttcctgcttctctttgctattgccgaaagagaaagtcagatatttcttccagttactggtttgcttttctttcagttcattcttgtccgcttctcccaaaacgattgctttactgccaatggcagccagcagttcttcctcattcttggcattatgcagtttgcgtagcttttcgatagcagcttcttccggacggacttcctcctttttcagaaactcactaaggatttcttctcctatcttctggtttgctttacgctctttgcggagaatggctgctatcttggcgcgggcacgggcagtggttgcaaaaacttcccattgcggttgtacgcgttgcgattttgaagtaaggatttcaacttggtcaccactttgcaatttgtggctcaacggcactaatttatgattgactttggcgccaatacaatggctaccaatatccgtgtgcagggaaaatgcaaagtcgagagccgtagagttctgcggcatagtcttcagttcgcctttaggagtgaacacgaatatttcagaagcaaataaatttagcttaatggtatccagaaagtcaatggcatccggttgcggatcatctaatatctccttaatcgttcttaaccatttttccaattcaccttcatcctcgctgcctcctccttctttgtatttccagtgggctgcgaaaccttgttcggcaacgtcattcatccgttcactacgaatctggacttcaatccattgtccgttgttacccatcagagtgacgtgcaatgcctgataaccattagctttaggatggctgacccaatcgcgcaaacggtccgggtggggtttgtatatcttggagatagaaacgtagatatcgaaacagtcattgagctcttcttcttcattacgtggttcgaagatgattcgaacagccagtaaatcgtatatttcttcgaaaggaacatgtttggtctgcatcttgttccagatggaatagattgattttacacgggcaagtatccggtatttcaatcccatcttatccagttgggtacgaatcggggccgtgaagtcgttgaaaaccttgtcacgttcagcggcagtagcattcaacttctcttctatttccgcatattcttcgggatgttcatatttgaagcttagattctcaagctccgtttttatcttataaagccccaagcggttggcaagtggagcatagatgtaaagcgtttcgcctgcaatcttatattgcttgttgggtaacatggaaccaagggtacgcatgttgtgcaagcggtctgctatcttgataagaatgacccggatgtcgttcgacatggtgagcagcaacttcttgaagttctctgcctgtgccgaagcgcggtcaccgaagattccaccggatattttagtcagtccgtccacaatctgggcgatcttcggaccaaagatattctcgatgtcttccactgtgtaatcagtgtcctctaccacatcatgcagcaaggctgcacatatagaagtggaaccgagacctatttcattgcatacaatgctggcaacggcaatcgggtgcataatataaggttcgcccgaacggcgtttgatacctttatgcgcctgattggcaaagttgaaagccttcgtaatgatttcaacttttttgcgatgcttagtattgagataatcattcagtagttcgtggaacgcctgattaatcatctcttcgtcagctatttctttgggggccagattatccataattgttatcctttcacttgcttagttctgcaaaaataagcaaatttccgaacgatgcaagcaggaagttatttatttgtatattttcaatcgttttcctgctgcaattttagtgctagacattccattccacctttgtatatccttaattgtgacaccatactttctggcaatagtggataaagtgtctccactttttattgtataataggtcagatttcccttaccggcaactgctgatgtcgttttgcgggttgcaggtgtaatatcctttacagcaacggttttccggttgcggaacaactcatcggcacgatgcgtataaatcgtatcttgcttatcgataaaagtactgatcgcgtcaataggcagtcttaacgtataaggtttgctgtcacccggaatcatttgcttcttatattgcggattcagactcttgatctgatccagaggtacattacaaaggtcagcgatttgttcgaagtgcagatttttgtttacttgcactgtgtcagtacttgccggaatattagtttccatcgggcagatattgtgatcgcagtagtaagtcatcacatagttggcagcgataaaggcaggcacatagccacgtgtttctttaggcagataattgtagattttccaataatcagtttcgccattggcacggcggattgccttattgattgtaccggggccacagttataagcagcaattaccaggttccagtctccatagatatcatacatttctttgaggtaacgtgcggcagcccaagtcgctttaatcgggtcacggcgttcatctaccaggctgtttgattccaaaccatagatcttacctgtaccgatcataaattgccacagaccggaagcacctgcacgtgatacggctgatgggttcaacgcagattcgataatcggcagatatcttagttccagtggaagtccgtatgcatccagtgcttcttcaaagatcggcatatagaagttgcaggcacttagcatgaaagaaacctgattgcgcaagcgtcctgcatacatatcgatgaatttgcggataatatcattataaggcatttccatgatggccgggatgcgtgacaagcggtcgatatagacagagtcactgaataaaggattgatttcagccgtactgcaatccttgcctaaatcaatataatttttagctttccagtcattcaatagactgtcaagtggataagtcatacttttaggcaggtcgatgctttctttgcgttcagttccattttcacgaatcactacatctacactttgcgcttttacctgcgacgtggccactagtaaaagaaaaataatcgaacaatagttaactaatttcttcatgcttcaataataagatcaatctaaattgtgttttttaaaatcgtaatacgcattgcagaccaaccgacttgtttttaaaactgttggagcggaactggttgttattatcaataacggccggctctactttcatactcaagtcgggggttatatcgaagttggataactccgcatctacataagcgtcgatgatagagatcaggtaaactccgataaatgcaaatatactaaggtcccgataacgacggaacatatcttttcttctttttagtgtgttttttagctgctcctcattataagtggagttcgggggcaacaaatcttcgtaacttttcgtattcggattgctgtccataatgtccagataggcttgcgaatagtctttgtacatcttaccgttccaacttaaggcgtaagcacaaccagcaaatcctccatatataataggtaatttccagtatttacggttgtaaatctgtcctccaccggggaatacgactgccagccacgttgctttggtcggatttgggataaatattttcttgttaatatcttgagcaggtggcggcacagtgtcggtctttacaacaatggaggcaggttgctctatctttttcagctctttcttgttggctgcatccaagctatccgctatctgtattttagcagctgacaaactgtcgatggccggaagttctttggatggtatgatttggatagaatccttcttcaccgagtcctgtattatcggatcacgatgccttcgtgcacgggctttcggcgcttcgcgctgtatgattgttgtatctttccgtgccggagtaacagtggattgtgcatacacatcaatccctgccacctgtaaaaaacagagaagcagggcgctgactagtaactgatatttcttactttttcttgtcatttacttctttagcgtatcgaagatttccatgatacgttccagttcctcctcgttcccgaaaggaatactgatcttgccttttcccttttcagagcaggtgagttgtaccttggtgttgaaaaagccggagagttgttgcttcaataagttgaattcttcaggaagtttgccacgtttgggtgttattttccgtgtgccgcttttcacagcttctccttcgcttaatgatttaacaatttcttctactttgcggactgaatatccgtgttcttgtatttcttcgaatattttaacttgtagtttagggtcgcctaatgaaatcagcgcacgggcatgtcccatgtccagctgcttgttttgcagggccatctgtattggagccggcaatttcagtaagcgcaggtagttggcgatcgtcgttcgtttctttccgatacgttcgctaagacgttcctgtgtcagttggtactgatcgagcagatgctggtaggcaagtgcgatttctacggcattcaggtcttcacgctggatattttcaatcagcgccatttccatcatgttttcgtcgtcggcagtgcgtatataagcagggattgttttcagtcctgctctttgtgatgcacgataacgacgctctcccgcgatgatctgatactcatcgtccgagagtttgcgtaaagtgataggttggatgataccgatttccgcaatggaatcagccagttcctgcaatgctgtttcgtcaaactcacggcggggctggttgggattgacagtaatctttgccagctctatttcattaatggaagaagacccttcggttttcacatcatccattgagagcaaggcgtcgagaccacgtcctaatgcatttcttttttgtgttgccatatcttcttctttcttttatttatttcggttgataatctctttagcaagggccaggtgatttttggcgccggtagattccgcatcgtaaaggatggtcgggacaccgtagctgggagcctcgctcaatttcacatttcgttgaataacggtgttgaataccagttcctggaaatgacgtttcacttcatcgtaaatctgattagcctgacgcagacgagagtcatacattgtcagtaagaaaccttcgatttctaaagccggattcagtttcgacttgatgattttgatggtattcaacaatttgctaataccttcaagagcaaaatattcagcttgaacggggataatcacggagtcggctgccgttagggcgttgatcgtgattagtcctaatgaaggagaacagtctatcagaatatagtcatattctttcttcaaaggcgtgagtacttcttttagtatcttttctcggtttgggaggttcagcatttcaatctctgctcctacgagattgatgtgcgaagagattactttcaaagaatcaatctccgtatcaaggatagcgtcctgtacgttggctctgtcaataatacattcatagatagtgcattccgactgcttgatgtctactcccaagccggaagaggcattagcttgcgggtcggcatctactacgagtacctttttttccagtgtagcaagtgaagctgcgagattaatcgtagtcgttgtctttcctacaccgcctttttgattggccaaagcaataatttttcccatattctctaaatttattggcagcgaaataagtgataaatccttagagcgcctacgaaaaaagagaaactttgcaatttctgttgataagtcgcctgttttgttaataactgtcggacgaaacggttacaaaacttcaacaggttcatcatcttcttttctctttaacgagcttgcaaatatacatatttatattggatatctatttctttttttgctcgcttgcagaagattaagatttgtaaacgggtaggagtggggcggaaagagacttttcgatctgatgtagggaggtgtttggcggtacggcttctttttgttacttttgtgcgaatataaaaaaggaaaggattgaagatatggaaaatgaaaagccgttgatacttgtttcaaatgacgatggcgtgatggctaaagggattaatgaactggtgaagtttcttcgccctttgggagatattgtggtaatggcacctgatgctccgcgctcgggcagtggttgtgcgctgacggtgacgcagcctgttcattaccagttagtaaagaaagaagtaggtttaactgtttataaatgttcgggaacaccgaccgattgtatcaaattggcacggaacacagtgctcgaccggacaccggacttggtagtcggcggtatcaatcatggagacaactctgccactaacgtgcattattccggcacaatgggagtggtattcgaaggctgtttgaatggaatcccttctataggcttctctttgtgcaatcatgcacccgatgccgattttgaagctaccggaccttatattcgcagtattgccgccatggtactggaaaaaggacttcctcctttaacctgtctgaacgtaaacttcccggatacgaccgatatcaaaggaatcaaaatctgtgaacaggcaaaaggtcgttggacgaacgaatgggctgcctgtccccgtctgaacgatccgaattatttctggttgaccggtgaatttaccgatcacgaacttgaaaatgagaggaacgatcattgggctttggcaaatggctatgttgctatcactccgaccacggttgatgtgacagcttatcactttatggatgaacttaacaaatggtttagttaactatcaactatcatgaagtattatctgattgtcggcgaagcttccggcgacttgcacgcttctcatctgatggctgccttaaaggcagaagatccgcaggctgatttccggtttttcggaggtgatttgatggctgccgtcggaggaacgatggtgaagcattataaagaactggcatacatgggttttattcccgtgttgctccatctgcgcactatctttgcaaatatgaagcgttgtaaaggagatattgtttcctggcaaccggatgttgttattctggtggactatccgggattcaatctggatatagccaagtttgtccatgcaaagacacagatcccggtttattattatatttctccgaagatatgggcctggaaagagtatcgcatcaagaatataaaacgagatgtagacgaacttttctccattcttccttttgaagtagagttcttcgaaggaaagcatcaataccccatccactatgttggaaatcctaccgtggatgaggtggtggcttatcagaaagctcatccgaaaaataaggatcagtttattgcggagaatcaactggaagaaaaaccggtaatagctcttcttgcaggtagccggaaacaggaaatcaaagataatctaccagatatgttgaaggctgcttctgcttttcccgattatcagcttgttctggcgggtgctcctgccattgctcctgaatattataaaaaatatgtaggagagtcgaaagtgaaaatcattttcgatcaaacctatcgtttgttgcaacacgcagatgtggcgttggtcacttcaggcacggctactcttgagacggcattgttccgtgttccccaagtcgtttgttattacactccgatagggaaagtggtttccttcttgcggcgtcatatcttgaccgtgaaatttatttcgttggttaatctgattgccgaccgtgaagtggtaaaagagttggtggcggatacgatgaccgtgaagaatatgcaaaatgaattgaaaaatatcattgaaaatgaagcatatagaaatgaaatgcttttgggatatgaatatgtggcggaacggttgggacctgccggtgctccctgtcatgcagctcgtgaaatgctgcgcttgttgaaaaaataactttctttttctgaataaacgtaaagccgatgcagtaattgcacggcttttttatttattaagcagaagactaaaaaaagaaaggaaaaagatatgaaaaaatttaagtggcttttaggaatgttgttattggcattagtgccaatgttgcaatcatgtgatgatgatggttattctatcggagatttcagttgggattgggcgaccgttcgggcaaccggtggaggaggttattatttggaaggtgatcgttggggattgattgatccggttgctacttccataccttggtttaaaccggtagacggtgaacgtgtagtggcctttttcaatcctttgtatgacatggaaggaggaaaaggagttcaggtgaaaatggaaggtgtacaggaattgttgacaaaggaagtggaagatatgaccacagaggaagaagcggtggaattcggcaatgatcctatcctgatttatcagggtgacatgtggttgggaggaaaattcctgaatgttattttccgtcaggagctgcctcgctcggagaaacatcgtatcagccttgtgcaaaataagatagaaacgggagaaccatcagaaccgggaacattgaatgtagctgaagatggttacgtacatttggaactgcgttataatacgtatgaggatgtgactgactattggggatggggacgagtttcttataatttggaaaagttcttcccaacggaaaaagatgccgaatcaacaatgaaaggttttaaagtgactataaattcaagagaacatggagaaggaagagtgatcgttcttgatctggaacatccggtaggtgtgccggaagctgcgaaggatgtacactccacttcttcgatccgataacctaactatgatttactgtgtgtgaaaaaggtcgggatacttctatcgaagttcccgaccttttgtattgtgtgcaattctaatcgatgagaaaaactcctgttagaaccatgttaatgcatataagtaaacgactgctgccggtatggccatcaaagaactgtcaaaccgatcgagcatccctccatgtcccggaagaatatttcccgaatcctttacgtgcaattggcgttttagcaatgactccgtcaggtcgccccatgtaccgaatataaccactaccaatgccagtcctgcccattccatcattgacataaatgggaagtagtgagcaagtataaaagacactccgattgctacaactccgccgccgatagaaccttcccatgatttcttgggagagatgcgttcaaagagtcggtgtttgcctatcagtgacccgatgcaataagcacccgtatcattcagccaaaggaaaataaagatggataacggtagaatcggattatagcttatgctactgaattccgatgccggatcattatggaaagccaatacattcagcaaagcaaaaggcagaccgatataaagttggctaagcatcgaataagcccagttaagtaccgggttctcctttttcagatacaactcgctaatcatcatgtaaagcaataaaagcacatacgggatgaatattttcgaatcggctgcatcaatgcagaatcccatgattgcgaggaataaataagccccgccgagcatattaatggtcttgtttatcttgactccttctgcgcgcatatttaccaactgtgcaaactcataaatagtcagtgcactgataacggtaaacagaatgccaaaactgaatgcgtcataaaggatgcaccctaccaagatggcaacgaagagtacacccgtaatagctcgttttatgaaattgttaatcaaaatctattcgttttaattatttggacccgttagcttgttcttctccattggacttaccctctacggtaactttgccttccactgtaaccttgttacctgctgcggcaactttggtgtcaatgggagcttgctcctctgcagtattttcagcttcttcttctttgatttctttttcttcttcttttaacttttgggcaagttccctttcagctcttgcggcatcctggctttctttagcagccatgatttcttccgaacgcgaagcccaggggcgtttgccgaagatacgttcaacgtcttccgcaaagattacctctttgtcaatcagtaattgcgtcagttcgttgtgaccttctttgtgctctgacagaattctcttggcgcggtcatactgctcgttcaccattctcttgacttcttcgtcaattagttcggctgtcttttcgctgtatggacggttgaaagaatattcatcgttgttgtaataacataaattcggcagcttgtcgctcatacctaaataagcaatcataccgtatgcctgtttagtcactctttccaagtcgttcatggcaccagttgaaatgcggccgaggaataaatcttcagcggcgcgtcctcctaaagtagcacacatttcatccaacatttgctccttagtagtaatctgacgttcttccggcagataccaggcagctcctaatgcacgtccgcggggaacgatagttaccttaatcaacggattggcatattccaataaccaggagatagaggcgtgtcctgcttcatgcaaagcgatggaacgtctttcagcttccgtagtaatcttggttttcttttccagaccaccgatgatgcggtctaccgcatccagaaagtcttgcttgcctacaaatttctttccgtggcgggcagcgatcaatgcagcttcattgcagacattggcgatatccgcacccgagaatcccggagtttggcgagccagcaagtctacatcaacactatcgtctattttgatcgggcgcaaatgcacaccaaatacttctttacgttcattcaagtcgggcagatccacatgtatctgacggtcaaaacgtcctgcacggagcaatgctttatcaagtacgtctacacggttagtagcagcaaggataattacaccgctgttggaaccgaaaccgtccatctctgtcaataactggttcaatgtgttttcgcgttcgtcatttcctcccattgcaggatttttgccacgagcacgtcctacggcatcaatctcatcaataaagacgatacaaggagctttctctttggcctgtttaaacaagtcgcgaacacgggatgcacctacacccacaaacatttccacgaagtcagaacctgccagtgagaagaaaggaacattagcttcacccgccacagctttggcaagcaaagttttaccggttcccggagggcctaccagcaatgctcctttgggtatcttacctcccaaatccgtatatttctgcggttccttcaagaactctacaatttcctctacctcttgtttcgcttctgccaaacccgctacatccttaaatgtaatcttgatggctccacctttttcaaaaagctgggcttttgattttcctacgttaaatacaccgccagggccaccactgccacctccgctcatacggcgcatgaagaagatccataacgctacaagcaagacaagcgggagtatctggatcaggattgcgggaaaaatatccgatttgggcggatagtcggaagaaccgtcaaaatgaccggcttccttttctgcctgcaaaaactcttccagtttatcggtagatggcgttctacttgtaatgatagggttacgtcccactttggtagagtccgctccaaaaacagcccctacagcagtcggtttaagaaaagcttcgattgacttatcttcataacccaatactttgtttacatagcccttttttacgtagtcctgaaattcactgtaagttacagctttacttccagctccctttgaatcactgccccaccagaggccgagaagcataagggcaataatcatatacatccagttcaggttgaacttcggcatattaaccttattgttaggtttattgctattgttattattgctattattattgtccataatcattaattagtctagatcggggatttgagtaagtttggcatctgcccaaaggtgttcaagattataaaaatctcttgtctccggtaaaaagacgtgtaccagtacatcggcatagtccattgccacccattcagcattccggagtccatcgattgcataaggtttgctatccgcacctttgcgtgtaaattccttgattgaatctacaatagcactcacttgactgggagaatttccctgacagataacgaaatatttacagatggtatcttctatgctggttaaatcggcaacgattatctttttaccttttttctcttgaattccttcttttattttttcaattaatactttagtatcgttcattcctgtaattgagattaataattcatgttctctatttgtttataacaaaaaaaggcaaccctttgtttctgattataaacgtgatatttttgacaaatatacgctgatttattggatacaagaaagttatccctcaatttttgtgttttttagtggagatacttttgtttggaaagcttatttggacatttttgcaaaaaaaatatcagaattgttttgaattcccaaaatatttgtatctttgcacccgcaaacggaaattattgggctatggtgtaatggtaacactacagattctggtcctgtcattcctggttcgaatccaggtagcccaacaaaacaccagctttttactgacaaaaacccgctaaaaatgcaattttagcgggtttttttgtgctttgacaaataccatccgaaaaaagttgacgctaattcggtggctaattcggtgacacgaatgcacgttgatagttcgaaaaacgctaatcttatgaaaagccgtgcggttgattgataaagaataaatccttaaactggctgtcgtcttgtttagtagaaaagaaaaacaggttttatagctcaagtgagtataaaacctgtttctaatttttctaaatcgggcagaactcttattcttctgcttttattgattcatcgattactttgatcttttgtaataccagttccaagtctgctttcaacttatctaccttgcggttcaattcagtcagcaggctgctgcctttcttagaagtagaagtcaggaagcctagattgttctcataagtctgaagctcattcttcatattctcataagtacgtaccagcttttcacgttctctgtacagagattgagtaccgcttccctggatattgctgatattcgaacggaagttacttaacttcttgttggaagcattgatgttaaagcggtcgaataactgatcgatgattccgtgatactgcttgtataacttatctttttctttgaacggcacatgaccgatagagttccactctttcattaaatcccgaaccaatgtacttgcttcttcggtatccatgctttcatcaatagcggataacttctcgatcaacgctttcttcttttccatattctctgtttctacagaacgttgtgaagaagtagctttgttcttttgttcgaagaagtagtcgcaagctgtgataaaccgtttccagatagcatccgagtgtttcttggcaaccggtccgatggtcttccattctttttgaagtttggtcagtgcatcggcagttactttccagtctgtactatctttcaaggcttccgctttttcgcagagcgctttcttcttttccagattctcgttcattccttctttcaggctcttgaagaattctcctttcttcttgaagaaatcatcgcaggcatggcggaaacgctcgaagatcttcacattcatcttttggggcgcaaaaccgatagttttccatttgttttgcaaggcaatcacttcctgggtcttgttttcccaggcagagaatgttttcagttcatcatactcaatcgcttcaacgatttcgcagatgacggttttttgatccaaattatgctgttcggcttctttcaacgattcgaagtgctgctgatggcggcggttgacagcggtagaagctgctttgaaccggttccatatttcatcacgcagttctttggctaccggacctgtatcgcggaactcctgatgtaacttctgaagttggtggaaagcggaaacaacatcttcctcgtcagccaacttttcggcagcttcgcagagatgcgttttgatttccagattctttttgaagtcgtattcgcggaactcattgttcagtttcaataaatcgtagaacttctctacatataattgatagtttttccaaagttcattcactttaccttgcggcaccagtttcgtatcattccattgctgttgcagcttcttgaactccgtataagatttgttggcgtcatctccggattccaccaattctttcagttcttcaataatggaaagtttcacttgcaggttttcttccttttggcgttccagctcggcaacctgtttactgcgtttttccttgataacccccatcaggcgtttgaattcttcttccgtcgggtcctcttcggcaacaaaatcttcaatgtttccaccgttgtctgtaaactgtaccttagcagcttccaactcggcattatgtaacttgtagaatgattgtttcagattgtcaatatcctgcttgttcgcattttcagcatcttgcgcaagctcttttagctggtttagtacatcttccttagtggcaggtttaggagctgcttcaggttgaacttcggcagtaacatcttcagccggagtctctgtaatagcttcagaaacctcgactgttttcttttcttcttctaattccccttggttcaagggttgattagtgtcatgagcgtccatcattgtatattagttttgggtcacaaattaatgaaataaaacgattacttcatactattttgcttatttttttttgtttatcgtgtttttatgataataaaacggttattcccatgtacaacatcattccgatgatgtcatttgtaatggctataaacggacctgttgcaatggctggatcgattttgaacttctccagcgtcatcggtaccagtgtcccgaaaatagaagcgaacattaccacggcaaacaagctgatggatacggaataggtgaccgtagccgttgcgccgaacctgataaagttgtaggtgtatactaataaggagataatagtggcattaattaaagctactaccgattccttggtaatctgcttgaaggtatttttagcgtccagcgagctgtttgccagaccctgtacgatgattgccgaagattgtgttccgacatttcctcctgtaccaccgattagcgggatgtacagtgccatttcgggatgggcagcaaaggtggagtcgaaattacccaatatcatagagttgccgattccgccgatcataccgattaatagccaggggaggcgggcggtggtctgtctcaatacattatcgtctgtttctacgtcctgcgaaagaccggatgccaactgatagtcacgttccgactgctcacggacttcatccatgacgtcgtcgacggtgatttgtcccacaagccgaccgatactgtcgacaacagggatagccaccaagtcatacttctcaatcgcctgtactacctcgtcaatgggagtatctacgtgtaccgaaatcggatctttctgcatcacgtgtttcactttcgatacagaaggggaagtaatcatctttttgagcgggaagatacctcgcagacgttcgtcatcgtcgatgacatatacataatagatttcgtccagctcttccgcctgttgacgcatctctttcagacattcgggcatactccagttctcgttgacgagtaccatttccgtacccatcaaaccaccggcggtattttcgtcgtatttcaacaagtcgacaatgtcacctgcctgttcaatgtcctcgatgtgcgaaagaacctcttcctgcttatcttcatcgagttcacgcatcaggtctacggcatcgtccgtatccatgtagtcaacgaagcgtttggcgattgtctccgaaggaagcatttcgagcagttctttacgagcgtcttcgtccatttcgacaagcacgtcggcggcaatttcattatcgagcaggcgatagatgaatttagcctcttccggattcaggtcattgcacaattcggcaatgtcggccggatggaggtcgatgagaagcccttttaccgtatcggcatctttttgctcaataaggtgtttaacgttgtcaatgtattcctcgttcatcgttgtcaattacaaattacgaattacaaaatccagttctctgcttactgctgcccgtagatcggttataggttgttgcctgccgtctttaatgcttcttccactttattggtcaggtcgataaattctgctaccgatagttgttccggacgtttattaaataagatgttctccgtgagtggacaatctttgcctaaaataggtttaatagagttgcgcaatgttttgcgtcgttggttgaaagtcgttttcactacctgtttgaacagtttctcgtcacatcccaattctttagtttcgttgcgcgtcatgcggataacagcacttttcactttgggaggcggattaaacacgtgctcactcactgtgaataggtattccactttataccatgcctgaatcaatacgctaaggataccgtaagtcttgctgcccggtccggctgcaatacgttcggctacctctttttgaatcattcccgtacagcaggggacgatatctttgttgtctagcatcttgaaaaagatctggctggagatgttatacggataattaccggtcagtacgaaaggtgtgccgtcgaatagccggtgaaggttcattttcagaaagtcatcttcgatgatgtggtcctccaacgacggataagcttcgcgaagataggcaaccgactcatagtcaacttctacgacctttatcaaccggtcttttttcaccaaaaactgggtcaatactcccatgcccggtcccacctccaaaataggcagttcagggaaggtgtcgacagtatcggcaatatcttgcgcaactttcagatctttcagaaagtgttgtccgagaaactttttaggctttactaatttcatttaccaactaaataattacttttgcagtcgacaaaggtaattcttttaaatgaagaacgtaccactatttattaaaaaataaatgatgtgtcagcgaagctaatgaagaattaaggatgaagaaactattaaaaaagacgctgaaactgatattaccggttgttttaggcggctttatcttattctgggtgtatcgcgactttgattttacaaaagcgggcgatgtattattacacggtacaaattggtggtggatgctcttctcattagtgttcggggtgttcgcgcaagtctttcgtggatggcggtggaggcagacactggaaccgttggacgctttcccgaaaaagagcgattgcgtgaatgctatcttcatttcttatgccgccagtctggtagttccccggatcggggaagtgagccgctgcggggtcttggcgaaatatgataacgtctcgtttgccaagtcgttgggaacagtcgttacggagcgattggtcgatacattgacgattcttctcatcacaggcatcacagtcttgcttcaattaccgatattcgttacctttcttcaacagaccggaacaaaaatcccttctcttgttcatctcctgacttcggtatggttttatatcatcctgttttgttttatcggtgtggcgatccttctttattatttaagaaaaacgctgttcttctatgaacgggtgaaaggctttgtacttaatatatgggaggggattatgtctttaaagggagtacgcaacattcctctctttattttttatacactggccatttgggcgtgttattttctccatttctatttcacattctattgtttcgcctttacggcacatttaggaattctagcagcattggtcatgtttgtaggtggtacgtttgccgtgattgtgcctactcccaacggggcgggaccgtggcatttcgctatcatttctatgatgatgctttatggggtaaatgtgacggatgccggaatctttgccctgattgtgcatggtattcaaacctttctggttgttctgttgggtatctatggctttgctgccctgtcgttcactaacagacatcgagggtgaaattttagctaaaagtgtgtattcttaaatgtttttgctgacgtcctttgccatctgaaaacttttccataacttggcactgtttaattattagatttaaaatcgttttaaaatatttattatgagtaccattctttctttagctccacaaaacgtgtggaagcatttttattcgttgacacagattcctcgtccgtcaggacacatggaaaaaataacagaatttcttctaggttttggaaaaggtttgggtctggagtcttttgtagacgaagcaggtaatgtaattatccgtaaaccggcgactccgggtatggaaaaccggaaaggtgtaattcttcaggcgcacatggatatggttccgcagaagaacaacgatactgtacacgattttgaaaaagatctgattgaaacttatatagacggtgactgggtaaaggcaaaaggtactactttgggtgcggacaacggactgggagtagctgccatcatggccgtgctggaagcaaaagacctgaaacacggccctctggaagctcttgtcactaaagacgaagaaaccggcatgtacggtgcatttggcttgaagccgggtaccctgaacggtgaaatccttttgaatctggattccgaagatgaaggtgaattgtatatcggttgtgccggaggtatggacgtaactgctaccctggaatataaggaagtagctcccgaagcaggagatatcgcagtgaaagttactttgaaaggattacgcggcggacattcgggattggaaatcaatgaaggacgtgccaatgccaataagttgctggttcgtttcgttcgtgaagcggttgccagctatgaagcccgtttggctagctgggaaggtggtaatatgcgtaatgctatcccacgtgaagcacatgcggttattaccattccggctgaaaatgaagaagaactgctgggcttggtgaaatactgcgaaaacctgttcaacgaagaatattcagctattgaaactccgatcagttttacggctgaacgtgtagaacttcctgccggtgaagtacctgaagaaattcaggacaatctgattgatgcaatctttgcttgtcagaacggtgtgacacgtatgatccctactgttccagatacggtagaaacttcttccaaccttgctattataacgattggtgaaggaaaggcagccattaagattctggctcgcagttcaagcgatagcatgaaagaatatctgactaccagcctggagtcttgtttctctatggcagggatgaaggtagagatgacaggcggatattccggttggcaacctgatgtaaattctccgattttgcatgcgatgaagtcatcctataaacaacagtttggtgtagaacctgcagtgaaagtgattcacgctggcttggaatgtggtattatcggtgctattattccgggattggacatgatttcttttggtccgactttgcgttcaccgcattcaccggacgaaagagcgttgattcctaccgtacagaagttctatgacttcctggtggcaactttggagcaaactccaatgaaataacgtatttctctttatataaatattctcctattatataataggtgaccatagtgaaggcacggatgatatttcatctgtgcctttttttcatatttattgcagcgtatattacaattctgctttataacaaataaattaattgatgcaaatcaagaaatatgctataaaacataaatttctctcttttttagatcaatgtataaacaaaggctgtatttttgtgttgtaaaacatgtaattaggaggataacaaaatgaaaagtttaaaaagattgtttagaaagatcggcgaagccgatgtacatgtttggggatattcaacaattaataccaaaccaaacaagtaagttttattttttagttttcaggaattagtaatttaaaaggtttaaagattatggcaaagaaaatgggttctttagttagaaaaatccttagtgaagtaggtcgtaatgaaatgctttcatgggggtacagaattgagaaatgagaacaagtacattaactaagtttagagtggggatacgttattaaatacgatatccccattttttatatctaaaattttatatagagttgttttagctaacaactgtggcgggggatctgtttcagtgtcagttcctcctttaatttctgtgtttgggtacactgtcttttgccacttgggctggaatgtatcacatgcgagtttggctgattttactatcataccctcaccgaatcacttgaaagcctttgttcatcgatgttacaaagggtgagggtaactgtgattgtagggtgagggtaatttttactctcaccctacaattatacctgtaataagtgcttaatagttgatttatagtaagttgtatgctgatttgtctggtactaatacatgaaagatgatgtatttgtgtctgataactggcgtaatattatctggaataacaggctgaacgagataatagatacggatgaattaattgtattccgtaaggtttcgattggcttctccataggggaaaatcagtttcaagcttgtgaacagtttgtttcatacgcttgaaacacttagtttcaaggtattaaacacttagtttcaaggtattaaacacttagttttccggtgtgaaactggtagtttcattacttgaaactgttggtctcaaggcataaaacagcttgttcaccggcatgaacaagccattttatgtagaggtgctgcaaattattgagtgtcttctatgaatatgcccggattcttataaacgagacagtgtgtaagatacctctatcttgcacgcatctgcaacggtatcttgcactgcttcaaatacttgtatatcagttgactatcgctggtttagtgtaaggtgcaagatacttttgcatttatgaacttgtaagagataggtgaatcttattgcagaagataaacttttcaattaaataataaaccgagtggcagtttttggactttttattttattccagagcgagttgattaataggctaatgtttatacaatatggtatggggctgatagcttgataaaagctttttttaagctaaaaagtacaaatctttaaactttatttccttactttgttatttataagagtgagacttatagcaaacttaaactagaaagattatgaaagtaaagcagatttgtatgatggtgctgctatggttgggagtgattccggcggtacaggcacaaactttcgacaaattatggaaagaagtggagcaagcggagaaaaagagcttgcctaagactgtgataaaactgtctgatgagatttatcagaaaggggaaaaagagaaaaactctccacaaatgctcaaagcatatacgtggcggatgaaatatcgggaaatgttgaatcccgacagtctttacgctgatttgaaaggactggaacaatgggtgaaacagactgaccaaccaatggatcgcgccatcctacactctttgatagcgggaatctatgcagattatgcagccagcaaccagtggcaactccgccaacggacagaaatcgtagaccagacacctgctaccgatatgcgtgaatggacagccaatatgttcatcgaaaaagtgcggacaaatataaaggaggcattggccgattctgtattgctgctcaaaacgtcctcacgcggctatattccttttgtagaattgggggaaacgagcgaatactatcaccatgatatgtatcatttattggcttcccgtagcattgaagcactgcaacgggtggaagaattgggtaacaggattactaatgacggtactgtgaatccggtcaaacaagatataatagctatttatgggaatatgatttccgcttataaagcaaccggattaaaagaaggttatgtgttgacagcacttaactacctggaatggagatggaatgctgatcggaatattcgacctctgcaggctaagggcgaacttccggtactgacggaagatacttatctgaaagctttgaacagattgaaaaacaagtatgcttccgaacccatctgtgccgaagtctatttggcagaagcccgatatactattggaaaacaacagcagctcaatgcattgcagctttgcgatgaggcaatccgcctttattcaggctatcgcagaatcaatgctttgaaaaatcttcgggaagagatattggctccttatttgaatgttaatgcatccgatttggcttttccgaacgaagagatagaattaagggtctcacacaaaaatctggatggtttcactgtccgtctttatcaggcgaagaaactgataaaggaacaacattacgctgtgcttcgtccgaaagattatcagacgcaggacactgtgtttacattcaaagctcctgaacttggatcttacgtgatgcgtatcataccggatattcgtgcgaagagagatagtgaaagcaagtttgatgtaacacgtttcaaagtgctgacgtgccgtttgccggacaaacagtatcaagtggtgacgctggatggacagacagggcatcctattccccatgcgaaagtgacgatgtacagtaatgacgaaaaagtgttgcaggagtttacgacaaacgaagagggtaaggtcgtatttccctggaaatccgaataccgctatctgaaagcttccaaggggacggatacggcaatgccgaaacaaggcatttatgcaggaagttacggatattacggcgacgaagataaagtgactgaaaatatgactttattgaccgaccgttctttgtatcgtcccggacagactgtgtatgtgaagggaattgcttattctcaacaatcggatacggcgaatgtacttccgaacaaggaatatacggtgactttattggatgtaaacaatcaggaagtagggcagaagtcggtacgtaccaatgagttcggttcgtttaccaccgatttcgcattgccttcggcctgtctgaacggaatgttttctttgaaagcgggaagaggccatacaggcattcgggtagaagattataaacgtccgacatttgatatcacttttgaaaagcaacaaggaagttacaaactgggtgatgaggtacaggtgaagggtaaggtacaatcttatagtggtgtgctgcttcaggatcttctggtgaaatatacggtaaagcgttctgcatacagcctttggcggtttgcggaatctgtgcagattgcttccggtgaagtgatggccaatgagaatggagaattcacgataccggttcgtttgcaggaaagtgactcttataagaataatgataaggtatattatcgttattccattgaggccactgttaccaatgtggcaggtgaaacacaatcttctacggacgtgatttcggcaggaaaccgttcgttgattttgcaggtggaattgcaagataagacttgcaaggatcaacccttcgaaacaatgtttaaagtgcagaacctgaatggacaacctgtggaggtgaaggggaattattacttgtaccctgccaaagacaaggactttaagcagttggaagagaaaccggttgcaacgggaacctttacttctaatgaagacatgacgctcgactggaagaatcttccatcgggaccttatgtgctgaaagcatcagtgaaagataatcagggcaaggaagtgactgctgacaccaacacgattcttttctctgttgaggacaaacgtccgcctgtagaaacgacgatgtggttctatggtgcaaatacggaatttgatgctgcccatccggccgtgttctgtttcggtacgtcgaaaaaagatgcttatgtgatgatgaacgtattttccggtgataaattgctggagagcaagacgttgaatttgtcagatacgattgtacgtttcgagtatccatatcgggaaagttatggggatggtgtctttgtgaatctctgtatggtgagggacggacaggtttatcaggaacaggtgcggctgaccaaacggattcctgataagacactgactatgaagtgggaagtgttccgtgataaattgcgtccgggacaaaaggaagaatggaagctgacgattaaaacgccgcaaggacaagctgctaacgcggaaatgctggcaacgatgtatgatgcttccttggataaaatatggaatcggcaacagaatttccaaatctattataaccagattgtcccatattctaactggatgagtggatattccggcaataattcattcaactactggtggaatacgaagagtctcaaagtgccatcactggagtatgaccattttgtgatgctatcggactattataataatggaagagatttgggtgaagtaatagtgagaggatatggctcgacgagaaagttgacggtgacaggtagcgtttcgacattggacgttgcaactttaaggagtaatgcgccaaagatgaaatcggctatggctgctgatgccatgactaatgttgaatttcaatcggaaatgatacccacgggagaaaaagcggatgaggcatctgacaacgaaatgcttcccgaagcatctgctgacttgcgtaccaatttagcagaaacagcattcttctatcctcaacttcgcaccaatgaacagggagagatctctttctcattcacgatgcctgaaagtctgacgcgttggaacttccgtggatattctcatacaaagggaatgttgacgggaacattggatggcgaagctaccacaagcaaagaatttatgctgactcctaatctccctcgttttgtgcgtgtgggtgataagacttctctggcagcttctatctctaatatgactggtaagccgcaagccggaacggtcagtctggtcctttttgacccgatgacagagaaggttatcagtacacaaaaacagaaattcagccttgctgccggaaagacaatgggtgtggacttccagtttatcgttagtgataaatacgaaatagtgggatgccggatgattgccgacagtggtactttcagcgatggagaacaacagttgcttccggttcttagcaataaagagcatttggtggagacacttccaatgccagtgcgtggagaagaaacccgtactttctcactcgatcatctgttcaatcaacaaagtaaaacagccacagatcgtaaactaactgttgaatttacaggaaacccggcttggtatgccgttcaggcattgccttcattgagtcttccgacaagtaataacgctatttcctgggctactgcctactatgccaatacattggcttcgtttatcatgaacagtcagccgaagatcaaagcggtatttgaaagttggaaactgcaaggaggtacgaaagaaacgttcttgagcaatctgcaaaagaatcaggaagtgaagaatatcattttgtccgagtctccctgggtactcgaagcacagacggaagagcaacagaaagagcgcatcgccaccttgtttgatttgaataacatccgtagtaataatatcgcagctttgactcgattgcaggagttacagaactcaaatggggcatggtcctggtataaaggaatgaacgggagtcgatctgtaactacctatatcgccgaactgaatgcccgtctggctatgctgacaggtgagaaattaagcggatcggctctttccttgcaacagaaggctttcgcttaccttcatcaatcagctttggacgagtataaggaaatcctgaaagcacagaaagacggtgtgaagtttactggcgtttcgggcagtattctgcaatatttgtatctcatcgctatttcgggagagcaggtacccgcagccaataaagcggcttatacctattatctttctaaggtaggagaattgctgacttctccttcgatggatacaaaagcgattgccgccattgtgcttgataaagccggacgcaagaaggaagcgcaggaatttgtcgcttctctgaaagaacatctgacgaagacagatgaacagggaatgttctttgctttcaacgagaatccatatacatggggcggaatgcagatgcaggctcatgtagatgtgatggaagcgctggaacagacaggtggcaataccgatacagtggaagaaatgaaactttggttgttgaagcaaaagcagacacaacagtggaattctccggtagctactgccgatgcggtatttgcattgctgatgaagggcgctaatttactcgacaatcagggagatgtacggattgtgattgctaatgaagtgctggaaactgttagtccaagtaaaacgactgttcctggattgggatatatcaaacgttctttcacacagaagaatgtggtggatgcccgcaagattgaagtggaaaagagaaatccgggtattgcttggggagctgtgtatgcagaatttgaatctcctgtcagtgatgtgaaacaacagggcggcgacctgaatgttgagaaacagttgtatgtggagcgtacgatgaataacgtgcctcaattacagcctattactgccaaaacggttcttcaggtaggtgataaagtcgtttcccgtttgagcatccgcgtagaccgtccgatggactttgtacagttgaaagatcagcggggcgcttgtttcgaaccgatcggcagtatctccggttatcgttggaacaacgggcttggctattacgtagacatcaaagatgcatcgactaatttcttcttcgatcatttaggaaagggtgtatacgtgttggaatatagttaccgtgtcagtcgtgcaggaacttacgaaactggtttggcaactatgcagtgtgcttatgcaccggaatacgcttcgcattctgcttcgatgacaattattattaaatagttccggcaggggatttttattctcaccgacgagcgaggcgttcctcaccgatgaagagggtgttcctcaccgaggaaggcatccttcgtcggtgaggaacttttttcttataaacaggggcttacaaggactgctattaagtaaagtcttttcccaatctgtgttaatctgtgtaatctgtggtgaaaaactcatctaaaacccctacatttgtgcaccaaaataaaaaatatcgcatgaaacgtagtttactatctatattatctttacttactgtcgctttggcagccgttgcccaacctcgtatctcttcaaataaagagacacataacttcggacaaattgagtggaaacgtccggtgacagtggaatataccatcactaacacgggaaaccagccattggtactgaccaacgtcacaacctcttgtgcctgtgccgtggccgactggaccaaagaaccgattgccccgggaggaaaaggagtagtaaaagcttcttttgacgcaaaagcgttaggacattttgaaaagtcgataggaatatatagcaatgccagtccgagcttggtctatctgaagtttaccggtgaagtagtgcaggaaataaaagattatacaaagctacttccttatacaattggaaatattcgtttagatcgtgatgagtttgctttccccgatgtctatcgcggacagcagccttcattgacctttgatatcgccaatctttcggatcgtccttacgaaccggtattgatgcatctgcctccttatctgaaaatggaagcggaacccaaagtcttgttgaaaggcaagaaaggaactatcaaactgacgctggatgcgagccagctaaaagattacggattgacacagacttctgtctacctttctcgtttctccggtgataaggtgagcgaagataatgaaataccggtttcggccattcttcttcccgacttctctcgtatgacggaaaaagattctttgaacgctcctgccatgcacatttcggaaacggatattgatcttagtatcccgttgataaagaagaataaggtaagccatgatatattgatagccaattccggaaagactccgttagtcatcagtaagttgcaggtattcaattcatcggtaggagtgagcctgaagaagacagtccttcctccggatggaatgacgaagctcaaagtaactattcgtaagcgtgacgtaggtaataagaagcatcatttacgtatcctgatgataacaaatgatccgttacgcccgaaagttgaaatcaatatcaaacgctaaatcctatgattatggaacatcctgaaaatagtgaagaatataaggggcttgttgtcaataaaggcattgagcaaccctcatctgtgaatccctacttaaagcggaaacctaagaaacgccaactttcagtagcagagtttgtagaaggtatcgtaaaaggtgatgtcaccatattgagtcaggctgtgacattggttgaaagcgtaaagcctgaacatcaggctgtttcacaggaaatcatagagaagtgtctgccattttccggtaattcgattcggattggtatcagcggcgttcccggtgcaggaaagagtacgtcgatagatgtattcggtctgcatgtactcgaaaaggggggcaaactggcggtattggccatcgaccctagtagtgagcgtagtaaaggcagtatcttaggggataaaacgcgtatggagcagctttccgtgcatcctaaatcgtttatccgccctagtccgtcagccggttctttgggaggagtggcacgcaaaacacgtgagacgattattctttgtgaagctgccggattcgataagatttttgtggagaccgtaggagtgggacaaagcgaaacggctgttcactcgatggttgattttttcctgttgattcagttgtccggtacgggcgatgaactgcaagggattaagcgtggtattatggagatggcggatggtatcgttatcaataaggccgatggagataatctggaacgtgccaagttggctgccactcaattccgtaatgcattgcatctgtttcctgcacctgaatccggatggattcccaaagtattgacttactccggtttttataacctgggagtgaaggaggtctgggacatgatttacgaatacattgactttgtgaaagaaaacggctattttgaatatcgccgcaacgaacaaagtaaatactggatgtatgaaagcatcaatgaacaacttcgtgacagcttttatcataatccgaagattgaagcgatgctcttagaaaaagaacagcaggtattgaaaggtaacctgacttcgtttatagctgcaagaagcttgctcgatacttattttgaggatttgaaatgagactttaaatgataataagattctgattcttaaagaatacatttagcataagcgggtaggaaacgtcagtctttctacccgcttgtactattaatgaggcttttctgctttttcaagatcagctctcgatttactttgagttacaatatatactcccaggaatacaagtgcgatagcaatccctttctcccagccgaaacttccgatacccatcgcgattgctgcaatcgtagccacgatgggttgcatataattgtacatactgactaccgtaggacggagcagcctctgcgcagtcataatgcagagatatgcgaggaaactacctcctaatacgacataaagtacctgtagaatggcgacagtggaaacagaagtccattgaatcgtagaaatatcataataggagaacggaatgtaacacattgaagcatatatgaacatccatttattaatcgttactgccgaatatcgttgagacaatcccttgaatacagtcaggtatatggagaaactgatttgtgcaacgagacaaagtaagtcaccaatcaggcttccatttccgttgcttcctgcctggctgctcataatgagaataagtgctcccatcgcacctacaaaaatccccagtactttcttattggtaataggttctttcaagtaaatggccgctacaaccattgttacaatcggtagagtggtagttacgatagaagcatcaataggagaagtcatagaaagcccgaagatgaacactccttgattgaatactagtgcaaacagtgaagcaaagaagattttcagcatatcttgatgattcacatgttcctgtttgcaaaacatggaaaggatccagaaagcggctgctgcccccaccatgcggaacgtagttacagaaattggagaaaactcttgaagagccgacttaccgatgggagacattaatccccacataacgtttgctgtaagcgcaaacaaatgaccatacaggttcttacttttgtccatgttgatactatttattttaccatatctctgatatcattaacaatcaaatagagaaaacggttgcaaaggtagtcttttatcgtatgatttgtttatatttgccttgattaaacttgaatattatggaacaacaagccaattatatccgtcgtatcgagatacacggactatgggaacgctttaatataggatgggatttgcgtcccgatgtgaacatcctctccggcatcaacggagtggggaagactaccattctgaaccgttcggtgggatacctcgaagaactttccggtgaaatgaaaagtgacgagaagaacggagtgcgtctctttttcgacaatccccaggcaacctatattccttatgacgtcatccggagctacgaccgtcccctgattatgggtgacttcacagcccgcatggccgacaagaatgtaaagtctgaactggactggcagctctatctcttgcaacgccgttacctcgattatcaggtcaacattggtaataagatgattgaaatgctttccagcattgatgaagaagagcgtcgtaaagcagctacattatctgtagccaaacgtcgttttcaggatatgattgacgaactgttcagctatacacgcaaaaagatagacaggaaacggaacgatatcgctttctatcaggatggcgacctattattcccttataaactgtcgtccggtgaaaagcaaatgctggttatcctgctgaccgtactcgtgcaggacaacagccattgtgtattgtttatggatgagccggaagcctcccttcatatagaatggcagcagaaactgattgctatgatacgtgaactgaatccgaatgtgcagattatcctgactacccattcgcctgccgtcattatggaaggctggctggatgccgtgacagaagtaagcgatatatctaccaccgtagggcacaagctcgacaaggattctcccaactgtaatttgtaattcgtaacctgtaatagaacaaatggcaacttcactacgagataatctgacttcttcttatttcaatgccgcccataagctttatccgaagaaagcccgccgacgtatcatcgcttacgtagaaagctatgacgacatcgctttctggcgcacattgcttgaagagtttgaagacgacgaacactatttccaagtgatgcttccttcggccacctccctggcaaaaggaaaaaagatggtactcatgaacacgctgaatacagccgaattggggagaagtctgattgcctgtgtggacagtgactatgatttcctgttgcagggagctaccaatacttcccgtaaaatcaaccggaacaggtatatttttcagacttatacctatgctattgaaaactatcattgttttgccgaaagccttcacgaagtatgtgtgcaggctacgttgaatgaccgttccattttagatttcaacttctacctgaagaagtactctgaaatagtatatccgcttttcctctggaacgtatggttctatcgccaacgggatacttacactttccccatgtacgatttccatacttatacttctttgcgcgagattaatctccggcatccggaaaagagcttggaatcccttcaacaacgggttaatcagaagttggcagagttgaaaaagaaattcccccataacatcaatcaggtgaatggattgcggactgaatttaaagagctgggcttggtgccggaaaacacttacttgtatatgcagggacaccatgtgatggataatgtggtaatgaaactactgattccggtctgcaccgtattgcgccgtgaacgggaacaggaaatcaagcggttggccgaacacaatgaacagttcagaaacgaactgacttgttatcagaacagccaggtgaacgtagaaatcatgctcaagaagaatgtagcctacaaaagactcttccattatgattggctacggcaggatatcagtgaatatttggaagaaggaaagaataaagaagaaaagaaacagagatcataaataaaagaaaaactaaaaaagagagagacgattgcttatgaaagaagtaaaagaagtggttgatacagtgagtgtggcattagcaaacgggcaaccggaagaagcaggtaatgtggtgatgcaagaagtgaatcatgctttgctctcgatgggagtggatgaagctatggctgataagattgataactttatcatcttattgtttattattggaatagcattacttgccaatctgatttgccgcaagattattctgcgtaccgtatccaaattggtgaaacagacgaaggccacttgggatgatattgtatttaatgataaagtaatggtgaatatcagcaggatggtggcacctatattgatctatatatctattcctattgcttttcccgaacatgcagactctgctttgcttgattttcttcgaagactttgcatgatttatatccttgcagtctttcttcgcttcgtcagtgctttgttcacggctgtgtatctggtatatagcgcgcgtgagcaatataaagacaaacctttgaaggggcttttgcagacagcacaagtcattctcttctttataggagctatcatcattatcagtattctgataaagcagagtccggtggtgttgctgaccggattgggagcttctgctgcggttctgatgttggttttcaaagatagtatcatgggatttgtctccggcatccagctttctgccaataatatgctgaaggtgggtgattggatcacgatgccgaaatacggtgcggacggtacagtgatagaagtaacattgaataccgtaaaagtacgtaacttcgacaatactatcaccaccattcctccttatctattgattagtgattctttccaaaactggcagggaatgcaggaatccggcggacgtcgtgtgaaacgttccatcaatatagacatgaccagtgtgcatttctgtacaccggagatgttggcaaaataccggaagatacaactgttgaaagactatgtggatgaaacggaaaaggtagtggaagaatataataaggaacatcatatcgacaactctgtgttagtgaatggacgccggcaaacaaacctgggagttttccgtgcctatctgactaactatctgaagaatctgcctaccgtcaaccaagacctgacctgtatggtacgtcagcttcagcctactgaaaccggtatcccattggaactttatttcttttctgccaataaagtatgggttgcctacgaaggcatacaggcagatgttttcgatcatgtgcttgccattattcccgaattcgacttgcgtgtcttccaaaacccgtcgggggcagacctgcatcggataggggtaaagatagaaaactaatcaaacgataaaacgtttataaattgtaattactatgactacaccgttatccaaccagattatccgtgaaatcactcctttgtcagataaggattgcttttacattgcggaacgttataaaacggaattcacttatcctatacacaaccactccgagtttgaattgaacttcaccgaaaaggctgccggagtaaggcggattgtaggagactcttccgaagtgataggtgattatgatttggtgttgataacaggaaaagacttggagcacgtctgggaacagaacgagtgccgttcgaaagagatacgggagattacgattcagttttcttccgatcttttcttcaagagctttatcaataagaatcagttcgactctatccgccggatgctggataaagcacaaaaagggctttgtttcccgatgtctgccatactcaaaatatatccgttgttggatacgcttgcttccgaaaaacagggattttatgcggtcattaagtttatgacgatcctgtatgaactttctctctttgaagaagaagcgcgtaccttgtccagttcgtcttttgccaagatagatattcattcggacagccggcgtgtgcagaaagtgcaggagtacatcaatacacattatcaggaagaaatacgtctggggcagttggccgatatggtggggatgacggatgtgtcattcagccgcttcttcaaactgcgtacaggcaagaatctttccgattatatcattgatattcggctaggctttgcttcccggttgctggtagattctacgatgtctatcgccgagatttgttatgagtgcggttttaataacctttccaatttcaaccggatcttcaagaagaaaaagagttgttcgcccaaagagtttcgtgagaactatcggaagaaaaagaaactgatttagcgcattttcttttatgaactcggtgattaactcccgagttctatcttccactcaccaatcgttcgtgtggcgctgtcaaagtttacacctactttaactattttcctgtgatccgcctgatacggaatagcataccccttgctgttaatctgcgctaatgcttcttcgggtgtaccatctactttaaattcaaaaacatagatggtatcttgaagtttcacaaccgcgtctgctcttccgatggctgtatccacttccacatctatatactgtcccatcagccggaaaaacagataaaagattgtttggtaatgtttctcctccttgttgttcagtttattcgggatagatgcaaagaaagatttcagtctttccagacactcctctaaatgaccgatacgcaagtctttaataaaggacactacataaaatgtattctctcgtgcaggcagatgcacataagcgggcatcagcgattcgataaatccttttcttacttccttgttgggataagccagtgtatacagttggaaatccggatcatatcccttaattgtgagataaccgctttggtagagcaccggaagaggatcggtgattctattgctgggcgcatcaaactgttcggcggtggcggtcgtgttatccagttcccggatatcaaaatcgctttcttgcagaatatctatcaggaaagtgggagtaccggtcgaaaaccaaaaattggcatacttcttctgtgcgaatgcattgaacaaactgaatggattataaatatcttcactgttctcactgaaatgatagccgtcatattgttgtttcaaatgtacacaggcttcctcatatgtttccttgttggcttgggccatttgttcaatatcaatttgcaattgcgtgcgcagttcttgttcggtgatgccacagatggcactgtaatcatccctcatgctgatattctgcaagttattcaactcgctgaagatactcatttggctgaatttgctgatacctgtcaataataagaagcgaagatactgtccctgggctttcagtggactaaagaaatcccgcatgatattacgtatttccttttgaacttcatcattatgattgctgtccagcattggtgagtcatactcatctattaataccaccacctgtttacccgtctgtttgtaagcacgacgaataattccttcaaaacgtaaactgaaagtcgtttctccttcttcccgttgataaattttctcccataaaagcaattggcggttaataacggctgacagcatatcagcggttatatatttactcacactaaaatcaaagtgtaataccggataaaccgtccaatccttttccagagtctccatagccaagccctgaaacagttctttttttcccaggaaataagcctctagtgtagaaactagcaaacttttcccaaagcgtcggggacgacttagaaaatagactttatttgtatgagtcaaacgataaatcaattccgttttatcaacatagacacaatcattattgcgtaaatcttcaaagttctgtattcctatcggatatcttctgaaattctcttccatgacgcatatctgtttttagcgtgaaacatacacaaagataatgatatttagtttcaagtcaattatgcctgttctttttttaagaaagtccaacgttggatatatacttagtgggaaaggagctatcggtgtttctttgcgtaatgcattgaaaagcgatgaaacatatctttgacgacaagcgggtggaaatacactatcagccaaaattttcaccttctcacaactgtcagacgattaattttatgcataatgagagataaaagagtgaagttccggtcttaaatttgcttataaacaagttgaactaatagcgtaagtaattgataatacgtttgtaacatcttgtcatcatcttgcaacgactctttcaatagattgtatttatttcgtcttatagttgtaatgcccaccctctatctttgccagcgtaattaaaacgtagagcaaagttagatgaaaaaactatttcttatccgattttcagtggcggccttcttttgcctgttgtgtgtacttcctgcattggctgccaatattaagattaaaggagctgtgaaagacaaactatccaaggaacctttgataggagctacgatacgtttgctcggaactcaagccggagcagtgaccgatatggagggtaatttcgaattgaacagcatgggcgtgttggaaggtatgtatgatattgagattaaatatgtaggctacaaaacggaagtgcgccgtaaagtgcgtgtggagaatggaaaactggtgatactgaatctggagttggaaaccgatgcacaggaacttgccgatgtggtggttgtagctaagaagaatagggaaaatgagaatatgctgttgctcgaacagcaaaaagcagtcattgccgtacaatctgttggtgtcagggagctttcccgcaagggtgtttcggatgcagaaggtgctgtgacgaaagttgccggagtgtctaaacaagacggagtgaaaaatgtctttgtccgtggattgggtgaccggtacaatgcaactacttttaatggatttgctcttccttccgaagatccggaatataagaatatctctcttgatttcttcggtacggatattattcagtccgtaggcgtaaataaagcattcaacgcgggaggcagcagcgatgtcggaggggcaaccattgatattgtatccaaagaactaattggtagcggtaatctgggattcggcatttccggtggcttgaatacacaaacggtagcagccgattttctgaaacaggatggagtgaacttcatgggctttgccaatcgtaccgaacctgccgatgaaaactcatggaacttcagaaataagttagacccttccgctcaacattttcaaattaaccggagttacagtatttccggaggtaaacgattctatgtcggaaaagacaaaaatccgctttctttcttcctgaccgccggacatacgacggactatcagtatacggatgaaatcatacgtaatacaactaccagcggtacggtctacaaagatatgaatggaaagaagtatgcggagaatatcagtcagctggcacttgccaatgtggatttcgatatgcagaatcgtcatcacatcagttataatttgatgatgattcatgccaatacccagtcggtgggcgattacaacggcaagaactcgatttttagtgacgactatgaaaacctcggattcacccgtcgccaacaaacgaatgacaatatgctgatcgttaaccaactgatgactaactggggattgaccaaatcattaagtcttgatgcaggtgcttcctataatatggtgaaagggtatgaaccggatcgtcgtatcaataacctgactaaagcggaagacggctatacgttgctaaggggcaactcacaacagcgctacttctcaactttagatgaagacgacttgaatgtaaaagcgggcttggtctatcgtctgaaagataatatagaagaaatttcgaatgtccgttttggatatacaggccgattcgtagatgataacttcaaagctacggaatataacctgaccgtaggacatgtttctaccctcccttctttggacgacttctcgcttgacgattattataatcaggaaaactttgcttccgactggttcaagatacaaaagaacttagatgaatataccgtaaaaaagaatatccattccgcttatgccgaggctacctaccagtttactccccgttggattgtgaatctgggaatgaaatacgacaaagtagatattgaagtggattacaatgtgaatcgtggaggctctaaaggaaacaataccatccaaaaagattatttcctgcccagcttgaatctcaaatacaatctgaatgataaaaactcgcttcgtctgggagctagtaaaacatatacgcttccgcaggcaaaggaaatatctccttaccgttatgtcggcgtgaacttcaacagtcagggtaaccccaatctgaaaccttcggatcattataaccttgatctgaagtgggactttaatcccactccgaccgagttgatttctctcacagctttctataaattgattaagaatccgatatcccgcatcgaagtggcaagcgccggaggttatctttcttatgagaatatagcggataaggcaaccgtggcaggagtggaagtagaaatacgtaagaatctgtttgtccgtccggtgagtaatgctgcgcacggaatgaataaactctctttgggattgaatggctcttatatctacacgaatgcaaaaatgcctttggcaacggttaccaccggttcgcaactggaaggagccgcaccgtggattgtcaatttcgacctctcgcataacttcacgaaaggagaacgcagttttgtcaatacattggtacttaattatgtgagtgataaaatatataccattggcacacagggctatcaggatataatggagcagggagtactgaccctggattttgtgtcccaagccaaactgaacaagcatctttcctttaacctgaaagcccgcaacctgctgaattcctcttataagttaagtcgcaaagcgaacgaaaacggggaaaaggtgatattgaatgattataagaaaggaataaatataagcctgggagtgtcgtgtacattctaagccgggtgatgaaataagattattaactaataatgaaagcaaaatgaaaagattgtttgtgaactttatgacgtttgccgttatggcaacagcacttacattgactgcatgtagcagtgatagtgacggagacggtgatggtaacggagatggtggaaacaacggtgggaccggtagctctattgttgtgggcgaaaatatcctgtccggcacgctgaccggagaacagacactggaagctaaggaatatattctgaacggaacggtagtcattgaaaatggaggccgtctgaatatccctgccggaacaacgattaaggctcgcgaaggtttcagcagttatctgctggtagcacagggcggtaaactttatgctgacggtacagctgataaaccgattgttttcactgccaattcaacaacccctacatccggctattggggaggaatcattatcaatggtaaagctccgatttccggttcgaacgccaataagagtgatacaggtctgacggaaatcgacaacaactataaatacggtggtaatgtcgataatgacaattccggttcactgacttatgtgaaaatctgctatgccggtgcccgctctactgccgatatcgagcacaacggattgacactgaacggtgttggaaacggtaccaagattgagaatatctacattcttgagagcgcggatgatgccgtcgaattctttggcggtacggtgaatgtaaccaacttgttggctgtgaacccggatgatgacatgttcgacttcactcaaggatattccggtaaattgaaaaactgctatggcgtttgggaaagcggttataccagtacggaagcagatccgcgcggcattgaagcagatggtaacttggatggtgactattcggatcatttacgtcagtcggattttacggttgaaaatatgacaatcgtaaataatgctgccaatacaacggataatgtagaccgtatgcaagatgtgattaaaatccgtcgtggagcaaaagctacgatcaccaatgcctttgtcaaaggttcaggcggtacaatcgatttgattgatatgaatgacagtaaaggtgcaggaaatgctgcttccagcatcagcatcacccatacattgaactttaagaataagctgaacggtacattgaatacatttaccgagccaactacgaatacaggtgcagatgcatccctgttcacttggagcggatataatttctcttccttataaataagatatagagtagcaaagtgtatcttttttaataggaggtatgggagaatttgtaacaaacagattctcccatattctatttatttgttttcgtaatcttcttttagcttttttatttgctcctttatggtatcagtgattacctttttcgtatatttgtcaacctattattttacaacgatacaaaatatgcaaacagacaacgagcgatacaaaaaaatggcttctcttgcacaaatcggatggtgggaagtagatttaacggcaggatattatttatgttccgattatctttctgatcttttgggattggacggcgacaccatctctacttcggattttctaaacctgatacgtgaagattatcgcaagcagattgcccaggagttccgggcaaattcttctatccataaggacttttacgaacaaactttcccgattcattcaaaatatggtgaggtttggctgcatacccgtctggcttttcgtgagaagggtacgggtgttgatggaggtgataagtccttcggaataatccagcgcgttgaggctcccaaggaagaagatcaaagggatgcattaaggcgtgtgaatgatttgctttgtcgtcagaattttgtttcgcaatcgttgcttcgtttcctacgtgatgaggcagtagaatcttgtatcgcagatattttaagagatattctgaatctttataatggaaaaggtcgtgtttatatttttgaatacgacgaaatttatgcccatcatagttgtatctacgaagttgtttctgaaggagtatcggcagagatagacaatctgcaggacatgcctgccagtgagtcaaaatggtggagtgaacagatattatcgggcaagccgattattttaaatacactggagcaattattagaagaggctcctgatgaatatcagattcttgtagttcagggaatcaaatcgttaatggtgactcctttgatgacaggcgaccgcgtttggggatatatggggattgatttggttgagacttaccatgactggagtaatgaagattttcaatggttctcctcattgggaaatattataaatatctgtatcgagttgcgtaaaactaaggacaaggtaatccgcgaacagactttcctaaataatctgtttcattttatgccgatgggatatatacgtatgtccattatccgtgacgagaataataaaccttgtgattatcgggtgacggatgcgaatgaggtcagttcaacctttttcgggcttcctttggagtcgtatattggttctttggcatctgaaaagcatcctgactatctccaaaaacttaattttctggaagaaatactggatagtaattcttatagagagaaagatgaatatttcccaagaacggaacggtatacgcattgggttatttattctcccggaaaagatgaaatagtcggtttgttcctcgattctacaggatcggtacaagctaatcgggcattggaccgtagcgagaagctctttcagaatatctttgctaatattccggcaggagtagagatctacgataaggacggctatttgatagatttgaataataaggatttagaaatattcggtgtagtgaataaatcggatgtgataggggttaatttctttgagaatccgaatgtgccgcaggggattcgtgatcgtgtgcggaatgaagatttggtagatttcaggcttaattattcttttgaacaggcggaaggatattatgagacaaatcgttctaatgcgatagaactgtattcgaaggttagtaaattgtatgataatgagggcaacttcagcggatatatattaataagtattgataataccgaacggattgatgcaatgaatcgtatccgtgattttgagaatttcttcctgatgatatccgattatgcaaaagttggttatgccaagttgaatctcttgaatcgcaaaggatatgctataaaacagtggtataagaatttaggtgaggaggaagatacgcttttggatgaggttgtgggtgtttatacccatatgcaccctgaagaccgtaagcgtttccttgatttttatgatgaagtcagagacggaaaaagaaggcattttcagggtgagatgcgtattcgtcgtcccggaacgaagaatgaatggaattgggtgagtagtaatgtgatggtcactaattataaaccggaggaaaatgaaatagaaatcatcggtatcaattatgacattacagaattgaaggagactgaagccgaattgattcaggcacgcgataaagcagagatgatggatcgtttgaaaagtgctttccttgccaatatgagccatgaaatccgtacgccgctgaatgccattgtcggtttctccgatttgttggtggaaactgaagagttgtcagaacgtcaggagtatattaagattgtacgtgagaataatgatcttttgttgcaattaatttcagatatactcgatttgtcaaagattgaagcgggtacatttgagtttaccagcggagatgtagatgtaaatctgttatgtgaggatattgtccgctctatggggatgaaagcgaaaggagaggtggaactggtacttgataatcaccttccggtttgtcatgtcattagtgaccgtaatcgtatacatcaggtgatctctaactttgttaacaatgcaatgaaatttacctctgaaggtagtattcatgtgggatataaactaaaagatggcgaattggaattctatgttgaagatacaggcatcggtattgaaaaagagcagttgccacatatctttgagcgtttcgtgaagcttaattcttttgtacacggtacaggattgggactttctatctgtcagagcatcgttgaacaattaggtgggcggattggtgttgattctgaaaaaggaaaaggatcaaggttttggtttactattcccggggtgatcgtgacggaagaggtgggctgtgcccggtagagtggtaatgaggcaggtgaatatcttccttcctcattaataaaagtgggttttatataaaagagacggtcttggttttgatgtcgattgatactgacatgaaaccaagaccgtttctttggtgaaaaggtgtagtccgtttaaattccgaacgacagtttatcgatggattgatatacaatacttgcaatacccagtccgatgatacccagcgtgcaaagtgccagtccccattttgtgcagcggtcgctgcggaaagtaggaattgggttgtcggaaggagtgatatacattgcttttacaatcaatagatagtaatacaacgaaatcactgtatttaccaatgcgatgaataccagcaagtggaaacctgcatcgaaagcagccatgaagataaagaacttagagaagaatccggcaaacggagggatgcctgccaatgagaacagagacagagtcatcaagagagcgattttgggattcgttttataaagtcctgcgtaatcttcgagcgtgaatttctgactgcgtaatgccacgatagtgataacggcaaatactccgaggttggcggcagcgtacactaatacataatataccaatgccgtcatgccttgtgccgtaccaccgataacgcctaacataatatatcccgcttgcgaaatactggagaacgccatcaaacgtttcaggttttgctgacggacagcaaatatatttgcaatagtgatagaagcgatggttacccaataaagtacttcctgccagtcattaatcattggagcgaatactttgataaggacagccaataatacaaatgctgccgatccttttgatataacacttaaataagcggtaactgcactcggagcaccttcgtaaacgtctgctgtccataagtggaacggaaccagtgataacttgaatgccattcctgtgaagaagaatacaaatgccatgatctgtaacggatttccgtcgatatgagcagggaggtcatcgaaataaagagtcccggcagaaccatagatcatggacagaccaaataacagcaatgcactggagaaaagagctgtcagaatgtatttggcacctgcttcggcagagttgtgacggtatttatcgaaggcaatcaatgctgccatcggaatagaagctgtttcgagtccgatgaagaacatcaggaaatgtccggcggaaatcatgaggtacataccaaacaaggtagagagtgtaagtacatagaattctccttgcttgaatgaagtatcttctcttttcatccattcgtgcgccatcaggaaaacaatcagtgtgccgacgttcaggatggatttaaccactgtgtgcatcggtacataatgatacataccgccgaatgcatcggcagcagtccccggaattaagttgatagctgtatggatagccatcagaataacgggcaacattgtgttcaggcgtgctttcccaccatttttgtgtgcatccggactcatgaagaggtcagctagaaatagcagcagtaggacagctatgagcgacagctcttctcgcatatatagaaattgtgaataatccatatttacaaattaattattaaagattaaaaattaaaggttatggaatcagttgtgagactacggggagtacactttcaccaatcatgtggctaacccagaaaggagccatacctagtccggctacacaaacgatgaggcagataacggctacacgttcgtcccaagtcgcatcagtcagttcgagatgatgtttgttggtgcaggttccgtatagaattttacctaccagacgcagaatgtagactgcagtaatcacaatcgaagaacaagcgatgatagtcagtacacggtggaactggtcgttgttctggaaagagccgacgaaaatagtcatttcagcaataaaaccacttaatcccggcagaccgaggttggcaagaccggcaattacataacatacactaaggaacggcatcactttcattaagccggcaagctcgcgaacgtcacgtgtgtgtgtacgtccataaatcataccgataagagcaaagaataaggctgtcatcaatccgtgtgaaagcatctgaaggatagctcctgttgctgctgtctgattcagcatcagaatagcgaaaagaaccagtccgcagtgagatacggatgaataagcattaatatatttcaagtcggtctgtacgcaagcggagaatgcaccgtaaactacagagatacctgtcaatatcaggaatatccaggaaagttcgttggcggcttccggcatcagatacatggcgatacggaaacatccgtaacctcccagtttcatcaatactccggcatgaagcatagatacggcagtcggggcagaagcgtgaccgtcagggctccatgtatggaacgggaaaagggcacctaatacaccgaaaccaaggaaagtcagcgggaaccagatgcattgctgtgcaaaaggtatgttgtgcaactgtgcgatttcaagaagattcatggtcgttgctcccgaaccaaaatagattccgagaataccgatcagcaggaaggcagaaccacccatcaacatgagggtcagcttcatggctgcatattctttacgtcctgatccccatacaccaatcaacaggtacatcggtatcaatgcgatttcgtagaacatgaacatggtgaataaatcgacggatataaagaatccgaatactcccatagacaatagggtgaaccagaggaaatattcttttgtcagcggttgcagacgccaggaagcgaatgtaccggtgaacacaatgacagcggacaataacaacatggctaccgaaattccgtcaacacctactgaataggatatgtgaagtggggcataccaaagcgtatctgcacggaaaagcatttctgccgtgtttccggcactacgctctcccagatacaggaatgtaagtacgacggaggcaatcagaagtgccgatgcgccagtaaccataaccccccggatggctttgattcctcgtgctgcccagagtccggccagcatcaataaggggataagtacgaatattgataagaaattcatatcgttctgtgctttataagattaatagtaggataagtgccagtgcaccgcaaaggaacacgtatgcatattgttgtacctgaccgctctgcaaaccacggatctcgtcgcttgttgtgttggttgcccatgccaggaaatcaaagaatccatccactacatgacggtcgaaccatgcgataggagtagagatgcagcggaagataatcttatgcgtgataaactggtatatatcgtcaatatagaagcggttataagcagccttgtgcagacctttgaactgtttttccaatgaatcggcaactggttgtttggcattcttgtacatccatgtagcgattgcaatcgaaataatcgcaatgacaacgctcgtaatagccaccgacggatcgagatggatagaataagattcaccattcgaactgatgaagtgtccgaaaggaataaatccggctccacaagttactactgccaggaacattagcgggaaagtcatagccagcggactttcatgtggtgtgtggtgtgcgtggagttctttgttttccttgccccagaaaataccgtagtacagacggaacatatagaaagcagtcatcgcagcaattactgtcattacccatcccattacagggctgtattggaagcaagcagccagaatttcgtctttcgagaagaaacccgagaacggaggaataccggcaatagcaagacaagcaatcaggaatgtccagtgagtgatcggcatatatttgcgtaaacctcccatcgcggacatttcgttagaatgtacagcatgaatgatactacctgcaccgaggaagagcaatgccttaaacatagcatgtgtgaagaggtggaacatggaagccatgtagcccaaacctccttcgtgaggatccatggaagtacaaacacccagagctaccatcatgaaaccaatctgtgaaatggtagagaaagccagtacgcgtttaatatctgattgtacgcaagccacacttgctgcatagaatgcggtgaatgcacctacccaagcaaccatgtgcaacgtattcggtgcataggcaatgaaaagcgggaacatacgtgccaccaaatatacaccggcaacgaccattgtagccgcatgaatcaatgcactgaccggagtaggaccttccattgcatccggcaaccagatatgcaacgggaacatggcacttttaccggcaccaccgacaaacatcaatccgagagccaacgggagcatagaagctccaccgcttatcaaggataccgtgtccggggtaaatccgaatgtaccaccataatatccgtaaatcaggataccgatcaggaaacccaaatcagcaaagcgagtaacaataaacgctttcttggaagcagcgatggcagccggttttgtataataaaaaccgattagcaggtaagaacttacccccaccagttcccagaaaaggtacatctggaagatgttggtcgcaacgaccaatcccagcatagacatggtaaacagggataggaaagcataataacgttgaaaacctacctcacctttcatgtaactgaaagagtagatatgtaccatcagtgacacggtagagataacaatcaacatcattactgatataggatcgagcaggatgcccaaatcaaagtgtaaggtctctgtaaaaggaagccacgtgaagttgtaaggtatcagtgtggcgaatgttccgtcttccagtcgtggagccgagaaatattggatagctgtaacgtaggatagtaccgctactgctcccagtatcagcgtgccaattgtgcccgctgtccggtgggacatccatttacctccgattcccagtatgagaaaggagaagaaaggaagaaggagtattagaattgttagttccatacagttttatttttattacttgatttattattatttgttcttggtgagaaacaaatcaccacttcaactcgtccaagttgcgcacttggatgcttcggagattacgataaatgttaatcatgatggcgatggctactgcagtttccgcagccgagatggcgatggaaaagagtgcaaagaaatagccttccattccctccggaaagagaaaacggttgaacacggcaaagttgatgtccgtggcattcagcattaactctacagaaatcaggatagccagtgtgttccggcgggtaaagaatccatagattcctgcaaacatcatgatggtagaaactaccagataatattccatgtgtatcatattcgaactctattttgatagttaatacttgtttatctcttacgtgcaattatgataccaccgatgatacaagccagcaacaggatgctgacagcttcgaaaggtaatatataaccgtatttgtcgctactaagcaaagcgttcccgatagcatgaatgttgatctcgtgcggggcaagattagccgtctgcatgaaattatgtttcaacgtgatagtcaggataattgctaaaccggcaatcatggtaatgagcccggccaggagcttacttcgttttgctttctcggcgcgatcaccttctccgctggtcaacaggatggagaatacataaagaacgacgataccaccggcataaaccattatctgaacagaccccaggaaggtgtaacccagcaaaaaatagataccggccgtgccgaagagcacgaagagcaggtaggtagccgagcgtacgatacgttgggtagtcaccgtcatgatggacattgcaataataaatgctgccaaaaagtagaatactactgtttcaagtgttgatcccatatctaaacttcttttttcttttctattactttactaccgtcatgatttaatttcaggacaagtttcgtccggtcgaagactgcatgttcgaagttctggtcgaacgtgatggcatcgtgcggacaagcattgacacagagctggcagaacatacaggcgcccaaatcatattcataggttgccaggattttctttttctttccatcttctgtttcgacggtttcgctggtcactttgatggtatcgttcggacaagccatttgacacagtccgcaagctacacagcgatgttcattattctcattgtggggcatattcagcgtaccacggaaacggtcgaacattttcagctctttccggttttcgggatattgctcggtcactttcttacggaagtataccttgatgctggttttcatacccgttgccagtgtactgatgccatgcatcagaccacctaagtacgtatattttttatctttatattccataattttcatttatcaaaagtggaagccgaaagctacgcagcatgccattaataatagatttaccatagaaattggaaccagatatttccattccagattcagaatctggtcgatacgtaaacgtgggaacgtccatttgatccacatcagaaggaacaccacgaagaatgctttagcgaagaaccagataaagcccggaatataatccattacagcgttgaatccatccagcccgacgatgtgtaacggcatccagcctcccaggaagatagtggcggcaacactggccacgataaacaggttcaaatattctgccagatagaagaaaccgaaacccataccggagtattctgtgtggtatccggcagtcagctcactttccgcttcgggaaggtcgaacggtccacggttacattctgcatttccggcaatcagatagatgatgaaagctattaccgcagggatatgtcccttgaagatgaaccagccatcagcttgcccttctacgatttcagagaattgcatggttcccatcagcactaccatcgtcataatactcataccaaccgaaagctcgtaactgataatctgtgcaccgcttcgcatggcaccgatcaaagagaatttgttgttactaccccaaccggccagcaagataccgaccactccaatgctggaagctgccagcaggaagaacacgcccacattaaagtcgagaatcgctgcacctttattaaaaggaatacaagcgaaagtcaggaatgaggcgataatcaccatgaatggagcgagattgtaaaggaaatgatcggcacccttcggcatgaagatttctttggtcatcatcttgagtacgtcgcagaccacttgaatagaaccccatttaccaacgcggttcggaccaagacgacactggaagaaaccgcaaactttacgctccatgtagatcaatatgatagccaggatggcatatagtgctacgaggcacacgccgacagctacacattctataaagatggctaatccctccggcataatggagagtagtagctcatgtatccagtttgttactatactaaagtcgaacatatattttttaatgattaggttttaagtattaagtattaattccatgcaggaaatgaccttttatattgtatagtcggttaatacttgatacctgttacttaatacttgttttttatctatcaatatccggaacgacataatcaattgttccgccaatagcaattaagtcggcaatcttcgttccccggcagatggtgtcgattgcggcaacaagcggcaatcccgtagcacggtagtgcaggcggtagggcattttgtcaccctggctttcaaggaagacaccaaattcaccacgacttccttctactgcagcataataactgccttccggaacacggatgataggcttcatcttctcctgataaggtccttcgggaatattgtctattaattgttcgatgatgttcagactttccatgatttcatccatacgcactaggtaacgggcaaagcagtcaccctccgtataaacaatttctttgaaatctactttgtcgtatacaccgtatggcattcgtttacgtacgtcacacgcccatcctgaagcacggcctgtacctccggtacaaccgaaagagatggcatcttcgcggcttaacacaccgacacctttcatgcggctttgtgcgatgatgttacccgtaaatatatcgtgatattcgtggatgattcccctcatataaggaatgaactcttttactcgtttgacgaagttaggatgaaggtcagcctgtacaccgccaatggtattgtagttcattatcagacgtccgccacaagtctcttcaaagatgtcgagaatcttctcacggtcacggaatccatagaaaaatgccgtcaacgctcctaagtccatggcaagacaagaatagaatagcaagtgagagtcgatacgttgcaattcatccataatagtacggatatacttcacacgttcgctaacctcaacgcccatggctttttcaatacacatacacagtgcatggcggttctggtgtgcacccagatagtcaagacggtctgtcaaggccaatgtttgagggtaggtaaggctttcattcattttctcgatgccccggtgaatataaccgcagttcgcatcaatcttacgaatgatttcaccttccagagaaacacggaaacgcattaccccatgagtagcagggtgttgcggaccgatgttaactacatactcttcttcaccgaacagcttcatctctttgtttttgatggttccgtcggggttcagttctatttcttgagtcgtatcaaacgtctcttcattggtcatacacaatgggttatccttttccggatcattatctttgcgcattggataacctatccaatcgttacgcagataaagtcggcgcatgtcaggatgacctacgaaggtgataccataaaaatcaaaaacttcacgttcatagaagtcggctatcttccaaatgtcgctgacagatggaatttcaggtagctcgcggttggttgtcgctgtttttagtgctatccgttcgcctgtaatggtcgattccagatggtagaccacgcctaaaccgcggagtttttccggagtgtctttctcatcggctactccccagtccataccggtgaggctttcgagaaagtccatctgtttatcatttcgcaagcgcagcatctcgtcgtgtaacgctgcaggggctataaattgtatttcttgcataaatcctttaaattacagaatgtagaatcattcttcattttttaaataatccggtttcttctcttttctgtttactccaccaaagaacttctctattttcactttgcgttgcaattgcatcatgccataataaaaagcttcaggacgtggcgggcatccgggaatatatacatctaccggaagaatcttgtccactccgtttaccacgtgataagactttttgaaaggacctccgctgacggcgcatccgcctacggcaaccacatacttcggatcgggcatctggtcatagagtcgtttcagtaccggagccattttattggtgattgttccgcataccataatcatatcagcctggcgcggactggcacgtgctacttcaaacccaaagcgggccatgtcataacgcgcggcacccagtgccataaattcgataccgcaacaactggttgcaaaggtaagcggccacagtgagttactgcgtccccagttgataaagtcgtcaagaactccgagggcaacgtttgctcctcctgcattaagttctttgaccaacttttccaatgattcattgtcgataaactcatcatacggaatagattttatttttggctttttggttatttccattccaaagctcctttcctccaggcataagcaagacccagaactaaaatgataaagaagaagagaacactaataagtccctgtggtcccatgtcgtgcataactactgcccatgggaacagtaaagcagtttcgacatcgaacataagaaataggatggcaaacaggtagtagcctacgcgaaactgcatccatgatttaccacgtgtcggtataccacattcataagcctcaaacttttgcagattgtatgaacggggagaaatagcacgcgaaagagctactactacaccgacaaaagcaagcgctgtcagtaaaacaacaactaaaaatgtaaaattcataattcaatagctgtttagattgaatattatatagaaataaacaattagtctattcgccctgtggagaataaaaccaactgtaataaatgacgagtaaaagagtctactgtactgtaggctaaatgactatctttcttaacccatatatataataggagataggatcataatagcacgttgggggatgagaagatgaagagtggtacggtctttgagaattgtgatgttctccggaaaaagcaactggcaacagtacgcttttatttgtcgggacatgcgtgacgtccgtgtgactcatatcacaagattgggtagcgtaaaggttgtaaagacgttctaaagcattttgtatcggacaatcttgcgacacgtagcatttctcctgccgataagtcggggaggaaactttgcacatatcttccattgctccgttagttgcacaatggataagcaaagccaatactaaaagtagtccgaattttaagttttgtttcatctttctcctttaacggctgcaaatatagaactaatatttatactttttgcaaagtccgagtggcaaaaaagctttttttaactccgcttctttacgattcgttttttagtcagtatggtttcacaaatctcgttttagaataggataatctctattatctttatttgttaaaagatgcaataaaaagaatgatttatgctcttttttgcgaattacacaaataaaatacatttttttgcagattaagaaagaatatactaatatgaaacgcacactttggtttttatttttccttctaaactccttgttttatctctatgcagatagtgagaatgattctttgttgaaggtgttggacaaagtgatttctgaacgtttgatatatacccagaaaaaagaagccaccataaaagaattgaagaaaaagaaggttggtcttaattcattggaggatatatataatttaaataaagaaattatccaccaatatgagacttttgtttgtgactcggcggaacaatatattcatgagaatattgatatagcaaaaataattggtaataaagaatatcttttggaagagcagcttcggttggcttttgtctattctttatcaggtttgtttattcaagctaatgatatttttaagtcgattaggtgtgccgatttacccgatcatcttaaagctttgtattgctggaatcgtatacgttattatgagaatcttattaaatacacggacgatgtacgattctcaaatgagtatatagcagaaaaagaagcttatcgagatactgttatgagtattttatttgaccagtcggatgaatatagaaaagaaaaagctgtaaagcttcaagataaagggagtacaaaagaggctcttctgattctgaaagagatatataataaacaggaaccggcatctcatggatatgctatgatggctatgggacttgcaagggcctatcggttaacagggaattatatactggaggaaaagtttctaatgctggctgctatgacagatacaaaattagccgtaaaagagaatgaggctttgttgacattagcagttaatttatatcataagggagatatagacagagcgtataattatataaaagtagcgttggatgatgctatcttttataattcccgttttaagaatacggtcattgcccgtatacatccgattattgagaacacgtacttaatccggttggaaaaacaaaaacagaatcttcgtttctatatatttctgactagcttgtttgtggtagctcttgccatcaccctgtattttacatataaacaaacaaaaattgtatctcgggctaagcggcatcttaaagccatgaatgaagaactggtcgggttgaataagaaccttgacgaagctaatttgattaaggagaagtatgttgggtattttatgaatcaatgtgccgtttatattaataagctcgatgagtacaggaagaatgtgaatagaaaaatcaagaccggacaaattgatgatttatataaatcatcttcccgtccttttgaaaaggaacttgaagaactttatcataactttgataaagcgttccttaaattgtacccaaattttgtagtcgagtttaattctctgttgaaatcggaagaacgctaccgtttggaaaaagatcaactgaatacagaattacgcatatttgcattgatacggttaggaattaccgatgttggacagattgctgtatttttgcattattctgtgcagacaatctataattataagagtaaagtgaagagaatgtccactcttgatagtaatatctttgaggaggaggtaaaaatgcttggttctttgtctcaaaaatgattctatccggtttaccaaaactaaaaaatggtcttgttataaactgttgattattaaatgtatatataataattgatctgtaaaacgtttactttcccgcctacttccattaagaagtaggcttttttcatctctatatttgcatcacaagatttttgataactgaatactaatctaaagaaacacacaactatgagtttttcagaattgtatcttatttattatcccaaactagttcggtttgcaaaagaatttgtgatgtcggaagaggatgcggagaacataacacaagatgtgtttacagacttatgggaaaagagagagtcaatgaatcatattgagaatatgaatgcttatcttttcaggcttgtaagaaacaaatgtttggattatttaaagcataaagtattcgagcaaaagtatgtcgagaatgtgaaggcttcttttgagattgagttgaatctgaaattgcaatctttggatcgttttgatgtatatgatatatcagaaagaaatcagatggagaaactgatacgggatgctatcaatagtttgcctaaaagatgtcgtgacatatttttgttaagccgcatggaaggattgaagtatagggaaatatccgaacgtttgggcatttcggtaaatacagtggaatgtcagatgggaatagcactaaaaaagttgagagcaaaactcaatgtaacattggctgcataactttttaatgattttatcggtattttttaggggtatttattgagataatcgttctttgataaaaaaggactgtgtatatggagaattgtctgaataaatattttgcggatgaatttacttctgatgaaaaaacagagtttctcatagaagtggaaaacaacgaaaggctgaaggaagaatttatagaaattcagaatttgctggcactcgttgattggatatctccggaatatgaaaataataaagaagttgtccaacataaattatatgaatttatgcgtagaatggagcaacacaaagataaatagctttaggatactatgagtaaaatttatatcatattactgactgttttcttttatgcaaatgtttattctcaacaagcttattttgttgatgggtatcatggcgggatatatggacattatccggtaaagtggaaaactcaattcattgtggatcagctggctatgcatccggactggcggatttgtatggagatagagcctgaaacatgggatacagtcagagtgcagactccggaggcttatttgcgttttaaagagatggctactagtaatcaggtagagtttacgaatcctacttatgcacagccttattgctataatatctcgggagagagtataataagacagtttcaatatggtattgctaaaataaacacacattttccgggggtcgattttgtaacctattcggtagaagaaccttgcttcacaagttgcttgccacaaatccttaaacaattcggctttaaatatgctgtattaaaatgtcccaatacctgttggggagggtatactgctgcttatggcggagaattggttaattgggtgggaccggacgggactgcaatcttgaccgttcccagatatgcttgtgaaaaactagagccgggatcaacttggcagacaactgcttggggaaattcggatgcttatttaaaagattgccgtaacgcaggtatcaaacaccccgttggtatgtgttttcaggatgcgggatggaaaaacggcccatggctgggaagtggaaagaacacaaaaaataactctatatatatgacatggagagattacattgaaaatgtctccatcggaaaaacggatgataactggtatttttcacaggaagatatacatgtgaatcttatgtggggaagtcaggttttgcaaaaaatagcgcaagaagtacgcgtttcagaaaatagaattgtcatggcagagaaaatgtctgtaatggcttatctggaaaataaatatatttgtcgacaagcagatatggatgaggcttggcgtacactgatgttggcacaacatcatgattcgtggattgtgccttataatggactgaatagaaaaggaacatgggctgatcagattaagcgatggacagacagtaccaatcatcttgcagatggaattattgaggcatctatgcagagctttaatgaaaagtttattccgcaaaataatgctcaacagcaatatatacgtgtttttaatacattaggaatgagaagaaaggaaatcgtaagtgttcttctgcctacggaatctgaaaatgcggatttaagtgtttatgactggaaaggtaaagatataggttgtttggtagaaaatgaaggtaaagagataagattattttttgaggcagagattcctccctttggttattccacgtattgtataaaaaagaaagaagccggtaagaaagaggcttcggagagtagattcgttttggaaggtaataaggtgaataaacaggaatacgtggttgaaaatgatatgtataaaattgtttttgacttatcaaagggaggaaccataaaaagcctgatagctaaaaaagaagggaataaggattttgcaggtaaaacggagaaatatgctttaggggagttacgaggctttttttatgaagaaggcaaatttcgttcttctatagagactccggccaagctgacagtagtaagggataatgtatatgagcaaaaaattaagatagagggtgagattgcttcccatccgtttacacaggtaatcactctcactaaaggaacgagacgaatcgattttgatttgacggttggctggaaaaagaatgtaggtattggtgaatataaagaggaacgttggcgtgataatcgtcgggcttattgtgacgatcggtttaaactaagtgtattattcccgactgatttacattctccccgtgtttataaaaatgcaccgtttgatgtatgcgaaagcaaactgactgatactttctttggttcttgggatcaaatcaaacataatattatacttcattgggttgacttggctgaacaggaaggcgactatgctctggctttattatcagaccatactacttcttattcttatggagaggactatccattaggactgactgctcaatattcgggtggaggactttggggacctgattataaaataacacaccctttgaggatgaagtatgcaattatacctcatcgtggcaaatgggacaaagcatcaatcgcagatgatagcgattgttggaatgaaccattgctgcattcttgctatccagtggcaaaaccggaatcgaaatcatttattgatttacagaatactggttatcaagtgagtgctcttcaaatgaaagatggaaaggtactattgcgcctgttcaattctgaaggggacgaaaaattacaaaaggttaccattgacatgccattatccggagtggaggaagttgatttgaatggacaatgtatcgaaagaaagaagataaaaacacgtgcaggtaaatcggaaatgacgatttcaatgcctcggtttggtattaagactttcgttcttagtttgacttaaaataattagattattgttatgtataaagcgactgctaatcttttaattgtttgctttttgtgttggatgacgggttgctcatcaaccaataccgtatcggaagatttggttccgactgattatgtaaacccgtttattggtgccagtactagtgtaggggctgccggtgtttatcacggattaggtaaaacttttcccggagctacgactccgtatggtatggtacaggttagtcctaatacaataacgggaggtgataacggttccggatacagtgatgaacataagacaatcgaaggatttgcctttacccagatgagtggtgtgggatggtttggtgatttgggcaattttcttgtgatgcctacaactggtgaattatataaagtggcaggtaaagagaataatgatagtataaaaggatatcgttcggcttataacaaagccactgaaacggctaaggccggatattattcggtagaattgactgattatcatatcaaagtagaaagtagcgcgacaccacactgtggaattttacattttacttatccttctagtgaccaatcgcgtattcagattgatttagctcgtagagtagggggaacatctacttcacagtatattaaagttgtagatgattatacaattcaaggatggatgaagtgcacacctgatggtggtggatggggtaatggtgaaggaaaagccgattataccgtttattattatgcacaatttagtaaacctttgactaattatggcttttggagtgcagatattcccgaacattgggttcggaaacgtgatgaagtagtgagtattccttatttgactcgtgtatcacaagctccggttataaaagacaagaaagaactgacgggtaaacatctaggcttttttactgaatttccaacgaaggagggagagactgtagagatgaaagttggtatctcttttgttgatatggagggtgctgcaaataactttgaacaagaaatagcctctaaaaattttggacaagtaaagcagaaagctactgaattgtggaataaagaacttaatcgtgtccggatatccggtggtacggatgatgaaaaaacgatattctatactgccatgtatcatacgatgattgatcctcgtatctatacagatgtagacggacgttatgtaggcggtgattataaaatacatacggctgacagcacttttacaaaacgtactatattcagtggatgggatgtatttcgtagtcagtttcctttgcagactataattaatccgcgtttagtaagtgatgaactgaactcattgattactatggcagatcagagtgggcgcgaatactatgaacgttgggaattgctgaattcctattccggctgtatgttgggaaatcctgctttgtctgttttggcggatgcttatatcaaagggattcgtacgtatgatgcagagaaagcgtatcgttatgccattaacacatcccgtcgttttggtaatgattcattggggtatgctccggaaccattgagtatttcaaccactttggagtatgcttatactgattggtgtatatctcaattagcgaaagctatggggaaagaagacgatgccaaatgtttctatgaaaagggacaggcatatcattctatttttgataaagaaaaggggtggttccgtccccgtaaagcagatggtgcatgggtagaatggccggagaatgcacgtcttaaagaatggtatgggtgtatagaagcaaacccttatcagcaaggttggtttgtacctcacgatattccgggaatggtgaatttgatgggtggtaaggagaaagttattgcggatttaacagatttctttaataaaactccttctaatatgctgtggaatgaatattataaccatgcgaatgaacctgtgcacttcgttccttttttgttcaatcagcttgaagttccctggtatactcaaaaatggacacgctatacatgtgaaaaggcttatgcaaacaaagttgaagggattgttggcaatgaagatgtaggtcagatgtcagcgtggtatgtgttggctgcttccggtattcatccttcctgtccgggaaatacacgtatggagattacaagtccggtttttgataaagtagagttcaatcttgatcccagctattatactggtaagaaattcacggtgatagctcataataacagcataaataacgtctacatacaaaaggccttgttgaacggtcaggaatacaataaatgttatcttgattttgcggacattgcagccggaggtacattagagctgtttatgggtgataaacctaatgttgagtggggactttgattgaataacatactttaaaacaaattgttactttaaaatcttgatagtatgatgaataaacttgggcttatcattgtatcggttatattagctctaatccagacagggtgtgcagagcagagtacatggatgtctttgaacagctctaatcctcggattatctgggaagtgaaaccccaggcagatttagagaacataaccggagagcagatttctactccggaatttaaaatgtccgattacgttaaaggtgtggttcccggaactgtttttactgcttatgttgaagcaggaatcgttcctgatcctaattatgccgataatatttataaagtagacgaaacgttttataaccgtcctttctggtatcgtacggaattcgaactcccgtcttcttattcggaggggaagcgggtatggcttcatttcgacaatacgaatcgctttgccgatttctattttaatggcgagaagatatcaggaacaaaaacatctactaaagatgtaagcggtcacatgttacgttcgaagtttgatgtgaccaatctgataaagaaatccggtaagaatgtgatagctgttctgattaccgatgccgatcagaaaaagacgcgtaaggctaaagacccgtatggagttgcgtgtagcctcagttatctggctggtgccggttgggactggatgccatacgtaccgggacgtctggctggtatcacaggcaatgcttatcttgtggtaacgggagatgtagtgatggaagatccttgggtacgttcagagttaccgaccttgcagaaagcagagctttctgtctcaacagatattagaaatgcttcttcttccccaaaagaagtcgttgtatccggagtgattcagccggggaatatttctttctctaaagacattcgggtagaaggaggaacaacagccagactatctattaacaaagatgacatagcgcaattggtcgttgaccatccgaaactttggtggccgaatggttatggtgatcccaatctttatacttgtaagctgacttgttctgtagatggaaaagtgtcggatgtaaaagaaatgacattcggtatcaagaagtatgagtataaaatggtcgataatgtagtgggatatcctgttcttacattctttatcaacggacagaagatctatctgaaaggtggaaactggggaatgagcgaatatctgcttcgttgtcagggtaaagagtatgaaacgaaaatcagacttcataaggaaatgaattacaatatgatccgtctatggacagggtgtgttactgatgatgagttttatgattattgtgataaatatgggattatggtatggaatgatttctggttatatgtagcatacaatgacgtggcgcaaccggaagcatttaaagcgaatgcccttgataaagtcagacgtcttagaaaccatccttccattgctatttggtgtggagcaaatgaaacgcatccggcacctgatttggataattacctgcgtgaaatgattgcgaaggaggacaataatgaccgtatgtataagtcttgctccaatcaggatggattgtccggaagtggttggtggggaaatcaacctccaagacaccattttgaaacttcaggcagtaatctggcatttaatacaccggcttatccatacggtattgatcacggttacggtatgcgtacagaaataggaacggccactttccccacatttgaaagcatcaaagagtttatcccggaaaaagactggtggcctctgcctactgatgagcagttgaagaatgatgatgacaatgtatggaacaaacatttcttcggtaaggaagcgtctaatgccaacccggttaattataagaattcagtgaacacacagtacggagaatcatccggactggaagaattctgcgagaaagcgcaaatgctgaatatcgaagtgatgaaaggtatgtatgaggcttggaacgataagatgtggaatgatgcagccggacttctgatctggatgagccatccggcttatccctcgtttgtatggcagacttatgactattattacgatcctacaggtgcttattggggagcaaaaaaggcttgtgaacctttacatatccaatggaatgcttctaataataatataaaagtaataaatactacagcaaaggacttgaaggctgcaatagctaaagctacaatttacaacctgaatggaaaagaagtgcctgcatacggacagacaaaacaggtcgatgtggcagccagcaacattgcagaagcattttctttgaactttaatcctttcaatctggcttatggaaagaaggctgtagcttcttcttcagcaggtgcctctaaaagtgcttcaatggttactgacggaggagcgggaagtcgttgggaaagtgcatacagtgatcctcaatggatatacattgatcttggtagagaagaaaagatagaaaaggttattttgaaatgggaggcagcttgtgctaagaaatacgaactgcaagtatcgaatgatgcgcaagaatggaaaaccgtttatgccaacaaagatggaagaggtggtactgaacagattgaattggaaccagttacagcacgttatgtgaaactggcaggcatcagccgtgctacacagttcggatattcattgttcgaattcgaaatctacggtgagaaaccaaaagagatagaagaactgactccgcttcattttatcaagttggaactgacagatgccaaaggtaatctaatctctgaaaacttctattggcggaatggtgtgaatgatcttgattataaattgctgaatacactcccagaggccgatttgtcttgccgattggtggataaatcgatgtctgacggaaagatgaagattgttgtaaagaacaattccgggactgtggcttttgctaatcgggtgaggcttgttaataaggctacgcagaaaagaatacttccaattattatgtccgataattatgtgacgttgatgccaggcgaagaaaaggttatcactatggaggcgactcccgaactgttgaaaggaggcgtaagtgtattggtgaaacagtatgggaaagcagagaagaataagctggatatagcagattgattgttgtacggttatctttatggtttgattaaaagaataaagaaaatggctaatagactaaaaatgaggatactcttgttgttatctttagtttatataaattgcgattacttacaggcacaaacaacaataccccggtttgaagaaggggaacgtgtggtatttgtaggaaacagcattactcacggcggacattatcattcatttatctggttgtattacatgactcgttttccggataaaccgattactatcatgaatgccggaattggtggagagagtgcgtgggatatgaaggatcgcttggactatgatgttttcaacaggaaaccaacttatgtgactctaactttcggtatgaatgataccggttatgatatttacatgaaaggcgatgcaaaagaactgtcggaacaacggattgcaaagtcattggaaagctatcaggaaatagaagaacgcttactggctaaaaataaaataaagaaagtattgattggtggttctccttatgatgagacttcccggtttaataattttatattgcataataagaataacgccattttaaaaatcatagatgcccaacgtacatcggctaaaaagaatggctggggttttgttgattttaaccaaccgatgcgtgagatatgcagaaaagagcaggaggcagattctacatttacattctgcaggatagatagaattcatccggataatgacggacagatggtcatggcctatttgtttctgaaagcacagggactggctggggatgaagtgtcatcagtatctattgatgcacatcattcatctgtaataacccataagaactgtaagatttcaaaactaaaaaagagcggagctgatctgacttttgattatctggcgtatgctcttccttatccgctggattctatttctagaagtggctggggaaataaaaggtcacaacgtgatgcaatgcagttggttccatttatggaagagtttaatcaggaacgttttcaggtaacaaacttagagaaaggaatgtatcggttaactatagacaatcagtttattgacaatctctcatccgaaaagttggcgaatggagtgaatttggcagattacccgaatactccccaatatcaacaagctgcgaaaatcatgtatctgaatgaggaacggtttgaagtggagaaacgtttcagagaatacttatggactgaatattcattcctgaaaaaggaaggattactgtttgcagatgatcaaaaagctatcgataagctaaaagaatacttgcctaaagatggttttcttaggatgagctacgattggtatataaaagcgatgaatcccgaaatacgggaggtttggagcaattatatgaagagtctcgttgaaacaatttataaaatcaataaacctgtcactcataaagtgaggctggcaaggattgaataataatagaagatgaatagaatgaaacgattgctatgtttaggtttgatttgttatttctgttgtctgtcgatgatagtatatggaaatgagaaaacttcgcctttctatttggcggaattaaaatgtgagaatcttattgatcctttggggattgataatgtaactcctcactttagttggaagttaaagggggacggctggaaaggcgggcaaacttattatgaaatacaggtagcttcggatagtattctgttggtgcaggataaagctgatttatggaataccggaaaattgaaatccaaaacttcggttatggtaccttatcagggaaaggctttaacttctcgttctttgtgttattggcgggtacgcgtttgggatgctaaaaaacaagcttcatcatggagtcctgttgcccgttttggagttggcatcttggatcagtcacagatgaaaggagaatatataggggcttctgttgaaggtggcaagatttgtgctcctattcttcgcaagaaagtgaaattgactcagggcgagacttctttcctgcatgtaaatacgttaggttatcacgaaatttatatcaatgggagaaaggtgggggaggacgttctgacccctgctgtatcacatttatctaaacgttcactaattgttacttatgatattactccttatttacgagaaggagaaaatgatttgcttatctggctgggacaaggttggtataaaacgacgactttcggagcagcttatgaaggtccgctggtaaaagcagaattggatgtgttgagaaatggtaaatgggaagtcgttacgaagacagacggatcatggtacggacgtgaaagtggctattcggatacaggtacttggcgtgctttgcagtttggaggtgagagggtggatggaaggattcttccgcgagatctttcaacacatgctttagacaaaatgaaatggactcctgttgtgaaagtgaatgttcccgatcatatcgcttcccctcaaatgtgtgaggtaaacaagatacatcagattttgcaggctgtgtctgtaaagaagctgggtgaaagtctctggctggtagatatggggaaggttcagaccggatggtttgagatgcaaatgcctatattgccggcgggtcatgaagttattatggaatatagtgataatttgacgaaagacggtgaatttgacaagcaaggtgaaagtgatatttatatatctggtggtaagcaaggagaatacttcagaaataaattcaatcatcacgcttttcgatatgtgcgcatctccaatcttcctcaaaaaccggaaacaggtgctatgaaatctctgcagatttatggagattataaacagaccgcaacttttgaatgttcggatgccgacttgaatgctattcaccaaatgattcagtatacgatgaaatgtctgacttttagtggatatatggtagactgtccgcatttggaacgtgcaggatatggtggtgatggaaactcctcaacgatgtctttgcaaacgatgtacgatgtagctccaacatttgaaaactgggtgcaaacatggggagactccatgcgtgaaggaggaagtttgccgcatgttggtcctaatccgggtgccggtggcggcggtccgtattggtgcggattctttgtacaggctccctggagaacgtatgtcaactataatgatccccgcttgattgagaaatattattctcaaatgaaagagtggtttaagtatgttgataaatatacagtagatggtttgctgaaacgttggcccgataccaaataccgtgactggtatttgggtgattggctggcacctatgggagtagatgcaggtaatcaggcttcagtggatttggtaagtaactgttttatcagcgaatgcttgagcactatgtataagacagccataacattaggaaaaagagaagaggcggaagagttcgctatccgtagagaaaaactcaacaagttgattcatcagacattctaccgtgaggatgaagggatctattctaccggttcacagttggatatgtgctatcctatgttggtaggtgttgtacctgattctttgtacaataaagtgaaagagaatgtcgttgccatgaccgaagaaaaatataaaggacatattgctgtaggtttggttggagtgcctattttgacagaatgggctgttcggaataaacaagtggatttcttctatcaaatgatgaagaaacgtgattatcccggttatctatatatgattgaccatggtgcgacagcgacttgggaatattggagcggagaacgaagtcgtgtgcacaattgttacaatggaattggtacttggttttatcaggctgtaggaggaatacgtcttgacgaggctaaccctggatatcgtcacttctatgtcgatcctcaaattccaaacggtgtgacctgggcaaaagtaacgaaagaatcaccttatggcacaattgccgttaattggaggttgaaagatgataatcagttgaatcttcaattgacaattcctgccggaacaacggctacagtttgcatccctaataatgctgtctcatgtaaaaagaataagaagaaagtgagcgttaaggagcagactgttgatgtagaagcagggcattatgattttctatttaatttgaaatagataccctactagagtgtatttatgattttcatttctcatattctcattcattaatcataaatggcagaagactaataggatagactatgagaaatgatttttaagatggtatttctcatagtttttccgtcaaataccccgtattttaccttatttctcatacttgttggatgcatttctcatagtgtttttctaatcaacctatacaagaataaagaaacagctagtcaaccattatcagggaagtacatattctccttgtcccatatattgtgggaaagtgttccctactagtagggaaaagattctcttattttgtgggaataaattctcataatattagggaacattttcccataatatatgggacaatcggaactacagtttatcttcaaccagaaaaaaggagaagatagtatttaactatgagaaatactctgaaatactatgagaataaggtgaattttaagctaaaatagaaggcgtattatgagaaatgccgtcttagaaagtctttctcataagctatttatttgattatttgctgtttatcagtcacctatgagaatatgagaaaggaaaatgaaaaatcttctctagaagctgctgaattttttattgatacatttaaaaacgcaccgtaataaactaatttatcatttaatttaagtctgtgcagaaacaaaattaactttaggaaaattgtccagtaaatggacttgaagttaatcgctttgattattatttttatatgattctttttaaatttctctttagtggtttcttaaatttcaagcgttcatagtataaagttcaatagatataggtaaaaagttaggattggtgtttgaaattcccaatattcctccggtctgtttattcttcttttatgagtgaccggaggagttgctggaaatcctgtttgaccaaaatgaaaatatgatatcatgaggactgttttcaaagcttttgattatgcaattgccagactaaaatccgttggcggaactaataactaaaataatatttaaatgagaaaaagaatatcgttattgcaaatggctgttttcttctttacggctcaggtagcttgggcaggtaatataaaaacagaaaaagtaacactggtaggaaatggaattgtagaatttatccccgtagggtatgatgtttcccgtacgccttcattaattctttcccatgaaccggaaaagaaaggtggagtaccggaaaactggaaattagttcctcaatttacgatgactgatggcaaggcaaatgcctcattggatgttccagccggaacaagtctgtatggaggtggtgaagtgaccggtccgttgctgcgtaatgggcaaaagattaaaatgtggaatacggataatggtatgtatcgggttgatggtggctcacgtctgtatcaaacgcatccgtgggtattgggtgttcgtccggacgggacagcatttggcgtattgtttgatagtttttggaaggctgaattgattactaattcagataaaattgaatttaatactgaaggagcaccttttcgtacttatatcatagatcgtgaatctccgcaagcagtattaaaaggacttgccgaattgaccggtactataagtatgcctcccagatgggcaatcggttatcatcagtctcgtttttcttacgtgccggaagctagagtgaaagaagttgccaatacttttcgtgaaaagaagataccgtgcgatgtaatatggtttgatatcaactatatggatgaattccgtgtattcacgatcaataacagggattttccagatccgaagcgcatgaataagtatctgcatgataatggattccattccgtgtatatgatagatccaggcgtaaaagtggatgataactattttgtatataaaaccggaaaagagcaaaatgcttttgtttgtgatatctatcgtaatgagtttcacgggaaagtatggccgggtgcttgcgcatttcctgactttacccgtccggagacgcgcacttggtggtccggactttataaagactttatggctaatggaatagatggcatttggaatgatatgaatgaaccgtctgtatttgatggtcctgggggaacgatgccggagaacaatattcatttaggaggaggcaatttacctattggtagccatttaatgtatcataacgcttatggtcgtctgatggtcgaagcttcttataatggcatgatggctgctaatccaagcaaacgtccatttcttctttcccgctccaatattattggcggacagcgttatgcagccatgtggacgggcgataacgaagctacttatgaacagatgaaactttctgtaccgatgtctattacattggggttgtccggtcagcctttcaatggtccggatataggtggatttgctgggaatacgactcccgatttgtggggaaactggttaggcttcggtgcatttttccctttttccagaggacatgcttcctgtgatacaaataacaaggaaccgtgggcatttactaaagatatagaaaaggaatcacgcatggcattagaacgtcgttaccgtttgctgccttatctctacactgcttttcatgtggctcataaagatggacagcctgtgatggctccggttttctttgccgatccgaaagatgaaagtttgcgtgctgaagagcaagctttcatgttggggacagacctgttgataattcctgcatttgcaaagaatccttctctacccaaaggaatttgggaaaatttatctttggttaaaggagatacaaaaggtaaatatcaggctaaattaaaagtgagaggtggttctattattccagtaggcaaaataattcagaatgtgaatgaaaattcattcgacccattgactttagttgtttgcccggatgaggatggcagagcggaaggctctctgtattgggacaaaggagatggatggggatttcagaaaggagattataaacagctaacttttaaagcagagttagtagacgggcatcatcttattgtaaaagtgacagacgataaaggggaagaccaaattgattttggaatgataaaggtagaagtattgcatgctggccatacttataaatcttctggtgatatagctaaaggcattacagtgaaattgtaaaggagaatacaataaatgaggagttcgtttatttaaccatcttctttttgtactgtttagaactaaacttcatccttataatccaaatgtgattactaaaaatagcttccagtcaaaaacatcagtaaaaaaggtttttgactgaaagcgaaccgaaagcaaaaaagagagatgagttcagtctcttttttagagcctctatattcgtttaatagagcctctgtttaagtgaaatgcaggcttcgtttcacttaaacagaggctctgttttattcacctgacgcgttctttgacttgttgtaaacgaaaactattcataaataatgtgttagggattgaagggaaaagtgtacctttgcccatcgtttaaccggagaagacaagatgaccaaaataacagtattgactacagacatcaatgtagtgtctattaataacgaagattatatctgcattactgacatgctaaaagccaaagatggcgatttcttcatatcagactggctgagaaacaggaatacactggaatacctcggtatatgggagcggttgtataacccaggatttaattatggcgaattcgccacaattagaaatcagtcggggttgaacagtttcaaaatcagcgtgaaagaatacgtggagaagacccatgctatcggtattcaagcgaaagccggaagatatggaggcacctatgcacacaaggacatcgcatttgaatttggaatgtggattagtgctgaatttaaaatctatttagtccgcgagttccagcgccttaaggagcaggaactcgcgcaactgggctggagtgccaagcgagaactgtcgaaaataaattaccgcatccacaccgatgctatcaaacaaaaccttatcccggcagaagtcacaccacaacaagcttcccgcatctacgccagcgaagccgatgtgctgaacgttgccatgttcggcctcactgccctcgaatggcgcgatgcgcatcccgacctgaaaggaaacgtccgcgactatgccacggtgaacgaattgatttgtctctcgaacatggagaatctgaatgccgtattcataggagaaggacttcctcagcacgaaaggcttgtccggctgaaccggatagctatccagcagatgcagatactggaagatgtaaacaagaagtacctcaagtagctgcttttaccagaatgaaccgatagatttttagcacgacaactataatagttttcgtcccgctccgcacaccgacttgtgtgtggagtgggacgttttcgtttacggcaagccatgtacccctacatgtacggattcggcttcctatcaaataataatgcttgatttacaatgtgttatcaatgaaaaaggggatgcatctatgaagacgcatcccctttttcattgatactactatgagtatttatcagtttattagaatgtaagttgtactcctaagttaaacacgcgctggttcatgtatgcatcaccggcggagttggacttgatttccgggtcttgttgatacttatcaaaacttgtccatgtaaacatgttgtaagcattgagatagacacggaggtttgtaagccatgaaggcaacacttttgtgggcacttgataggagacgtcgatggttttcaagcggatgtaccaagcatcaatcaaccaaaagtcggacatatacgctgctgcgctgtttacagtcgacggattgcttgttaagcgcggaaattcgatggcttcaccgttcaggtagcgttctaatgtccagcgtttctggtgtagaggttggaattgactcttgaaaggttcgatacctgtgccgtttaccgagaaactgtagttgaacgaaccttggaagagtacgctcactgacaatcctttccacgaaccaccgattgtccatcccaacgtggtgttgggtaagtttggcttaccaatagctcccttgtcgaagtcgttgataacaccgtctccgttcaaatctttgtatttcaagtcgccggcttggataggaacgtcggtattgggcacagccggtgcatttgcggctcctgcatgaatcaagtccacttcttcaggtgtataataacctatccaagtgtaaccgaatggttgaccgataggacgacctgttgccgacaaccaatcgtatctttgttgtgcttcggcattaaattctaccttattcttagcatacgagaatacgaagttggtattgaagttgaactcaccgaaacggtcttgataaccaatctgtccgtcgaaacccatattgctggtgcgtgccacgttgataggtgaagtacccacacctaagatctgcggtatgtcattgcgtttcacaagctgattgtatcgtttgtcatagaaccagtcgaaagtaaatgagaagcggtcgaatgcattgaagtcgagacctatatcaaacttcttggcttcttcccatgtcacactgctattgccaaggtcaccttccgtaatagcagtggaagtgacatcgctttgtccgaaattataagcattatcagttgctgtatatatctggttgtaaaggtagcggttacccatagctacgtccgaacctacaataccatacgaagctctgattttcaatagttggatgaaagaaatgttatccttgaagaacgattcttcggagatacgccaacccacaccaatagcagggaatattccgtagcggtgtccttcggcaaaacggtcggtaccgttgtatgcaacattgaagtcgaccagatatttatctttatatttgtaacctacggtagcggtaagaccctgaaagttttcgggaatcttttctcctgtatcgtctggatttttttctacggtacggctttggcggctatacagcaacgtggcactaacgtcatgtattccattgaatatgcgtgcatagttgatggaggcctgaacatccagatttttcacagcctggttggttccggccgtcagagcatactgtgaataagcatatttacggttggggttgatgttatactgatccgtagtaggatcgtagtggtaggtagggtacgcatcttttccacggtttactttgcggaagacttcgtcaatggtagagtaagcaatacgagcattggctgacaatcctttggtgagccaatccatcttccagttcacaccgtagagaatgttgttatcgttacggcgtgtacgcgtgtaaccttcgttagccaaacgtgcattcaatgtaggtccgtaaccgtccacatctgaaagataagcatacgatccgtccggattgagtaccggtgccgaataggggtgcatggcggtgaaattgtaaatctcgcctgtagcattcagactactcggttcgttgatgttcatgaagcgcgaactgaagtccagacgcatagtcagattatcagtaacagtaaagtccaagttggtacggtagtcaaaacggcggtaaaaatagccggtattcacatcgtcatccgctttagcaaagttacgaaccaaaccaccttgtgagaaataccccccggatacgaagtatttcaaacgtttggtaccacccgatacgtcgacattgatgttcgactgcatagccgattttttgaacacttcgtcgtaccagtttacattaggatgtccgtatgggtcggaaccgtctttaaacagttccaaatcatgttgtgtaaacattttagtcaaaccatcgttagtacgtgcctcgttgactaacagggcggtgttgtatgagtctaagaagttgggtttacggacaggtatctgaccgccggcttctgcacgcacatggatcacaggttttccttcttcaccgcgacgtgtcttgactaccaacacaccgttagcacccttgataccataaatagcagtcgttgatgcatctttcaaaatagatatgctttcaatctcattgacattgatttgtgacagctgttcgtaactgtattccacatcatcaaccataataagcggcttgttaccgtcctcattcaaggaactgacaccacggataaagaagtcggaagcatcttttcccggctgaccggaacgttgctgactgaagaagccgggcagtttacccgataatgtattctgtaagctacttgtaggaactctacgtaattcgttggcttgaataccgctcacggcaccggtcaaagtgatacgtttcgcgctgccgcgacctgtgataacaacttcgttcaggttgttggcttcggaaacccttaatgcgatattcagtgtgcgctgatttgttattgcgacttcctgattttgatagcccacaaacgaaaataccaatgtttcgccacgtttcacttccagcgaatattttccatctatattggtgatggtaccccttccggctccctttaccagaataccagctccgataagcggttcgttgctttccccatcaataatggtaccgcttatcgtaaacgattgggagtatgcctgtacaatgcagaggaggcacaagaatgttataattactcttttcataagatattaccaattagggttttgaaccatattcttattttttattacttccgaataaggaatcggatagaaataacgtttattgtcccattgtacattgagtacagcttgcggaacataggtcgtggaagtctgtgatttagtgatgtacattccttgaataggctgtgcatagacctgttcggcaagtcgccaacgacgaatgtcccaatagcgatgctcttcaaaagccaattcaatgcggcgttcattctgaatcactttgcgcatttcggcttgcgtcaaattgtgtgtctgctcattggttgttagtccatacaaattcttttcaccaggttcgatacctgcacgtcggcgcagggcgatgatagcatcatatacagcttgtgaaggagtagacaaatattcgttttcggcttcggcaaagttcagaagtatttcggcgtaacggaacatcacccagttgtgttgtgtgtcttgatattcgttggctgcttcgaaatcacccataaacttgcgcatgtaataactcgtgagcgagtacgacgaaccaagaggattattggctccaccctgccatgtttccatcgtagagttcacccatgacgaaccattgtgtataatggtatattccaaacgtggatcacgttgtgcgtaaggaagctgttcattgtattcatatttacctttatcattgataaagtgaccgtctttcattaaaaaggcatcgactaaattctgtgtgggattggtgcggccgtttccttgtttggcaccgctaagtcccaatggaccgttagctgtttccaccgtcttatccattgcgttttcacggaagaagataacttctttatgttcgtttgaataccaattggtaaatacattcttgaaattatcgtcaagtcccatgatagctccgtcacctgttccgtacgtgttaataaagttgcgggcggcatcggctgctattttccaacgttcgcgatcataagaggcatatcctatcaactcattaccagattcaatgggcttttcgttgaataacggacttgctgcatagagcaatacacgaatcttcagtgcctgggctgcctgtgtgtttactacgtgtgcgctcgcagcggcatcaggtagtggcagcgaacgaaggtcatctttgatatcgtcaagctcacttacaatatacttgatacattgctcgaacgtgctacgtggcaattcgatgttttcgttcaattcgtacactttatcaccgataatgggcactccaccgtagcgcttcaccaattcaaaatagaagtaagcacgcaggaaccgggcttcggctttcatagaatcattgagcctgcgtgtattaccgagtgcatcagtgtaagtagtgttgaaaggtactacgtcaatgccactcaacagaatgttcacgcggcgaatcaccaaataagggtcgctccaaatcatatccgagttaataaaattggaggcactgtaacgtccgatggccagtttgtatacatcggactcggacgaaataacagagagcgcatcgtcggaagcggcatccaggtagtcaccatttacgccgttgtgtccattacgcatgtaatagtagatgcggttgaggtatttacgtactacagttccgttggagtcggtcttcgagaagaggtaatcttctgtaaacatatctacaggcgtactctcataactgtctgtacatgcggcagcactcaataacagcataaatgctcctactgcccatgtgccatatttattttgtttcatatccatcatttttattagaagttaagattgattccagtcgtaatggtgcgctgtaacggatagctggtgaaggtaacttcagggtcttgcaagcgggtacgtgaccatgtgagtaaattttgtccctgtacaaatattttcacgcgcagtccgcctaagtaattacggcagaagttttcgggtagtttgtacgatacggtggcgttcttgagacgaatgtagtttccgttctgtacaaagagtgaagagttccagttgtttccgtagttgtacatattgcctccggcagtcagtctcggatacgtagctgtttcagcagtttcgggtgtccaacgattcagcaaattggtgtaagcttgtccgtagctttgtccgatcacttggaatccttcgagcaacgtgcggtcgctattatataagtcgcggttgtaagcaccttggataagtgctgtaacttccaaccctttccattcaaagcctaaatcaataccaaaatagcaagtcggtttgtcgccaccaatcacagtacggtcgaattcgttgatttcgccgtcaccgttcatgtctttgtatttcacgtcacccgcttgaatattgttgaagccgttcattacgggataaccatcggctatgtctttagctgtgaggaatccggtagctaccaatccgtagatggtaccggtgggttgacctgtcattttcagatagtcgtaaggtacgtattgctcgtccatgaacaaccgtttgttctgttccatactccagttggctgatacataatagttcaccttaccgatgtgatcttgccagctaagttgtgtttccaatccgtagtaacgtgtttttccgatattttctgccggataagcaatacccagcaattcgatgctcttaccacgtgattgcaatatgtcatagtagtagtcattgtaatagtcggccgagagagtcaaacgattctttaacaaggttaaatctaaacctacattgaccttccttcctttttcccatgtcaggagggtattagccaatggggatatttctgacactgaacctccgttgctcatggatgtaccgttgctataccagaatccgccatcttcattgtatctctttaaatagctgaagtaaccggcattgtcgattccgtttcctgtatgaccgtatgtggcacgtaacttgagttggtctatcttcgatgcctccataaacttctctttgctgatatcccaacccagacctactgcccagaatgttccccagcgacgtccattgtcatagcggttgtaataactttccgttacggctgcttgcgcgaagtatttgttatcgtaattgtattcaactttctgtccgatgttcgacggaatcataggcaggtcgtagttgttgagtatagtacgtgtatcgccccaaagtgaagcttttacaccatgcataccgaattggcgttcccagtctacatacattttgccatacatatattggtacgtcgatactgaacggtaactgttggtttgtgaacttacatctccatacttgtcataagcctcgttgccttgttgggttatgctgtattgaaatacttgtgcctgtttagtacgaacgatagcattacgcacttgcgatgagatgtttcccgttgcaccaacagaaagtcctctcaccaatttatcgaagtcatatttcaaattaatggttcctacgacgtcgcgggtattgcttgagatatatcccgaaccagtggtctgtgcatagaggttttgggtatacgaagcgttaccaccatacgtaccgttgggatttaagacgggataagcattgttgggagtttgccatacgttgctcaaaaggtcgctgtatcctgtccccgaaatacctccaggttggtttccttcctctatacgtcccattaaagacatgcttaccttaaattcatctgtcacgttgatgtttaccttcgatgtgatgagataccggttgtacttgaaattggtgttgtagctattagcatcgctcgtcttgaacaatccgttttcgctgtaatatcccaaacttacaaagtattgagccacccgtccgccacctgttacattcagattataggcttgcgacgtagtagaattgttcataatagcatctttccaatttacgtcgggatgcagataaggggaagttccattacgataggcttcgaaatcatcatacgtatagagtggtgatttgccatcattgagcaatgcttcgttgagcaaataagcatattgataagccgaaagtggatttgggccagatttcaatgcactggatataccaaactttccggtgagtgagagatggaaaccaccttttgcatcaggatttttggtagtaataatcaatgcaccacgtgaactgcgcattcctaaaaacatattggaaagggcatccttttgaatggtaaccgattcaatggcttcgggatctatggaatacaggtcacgttctacaccgtcgacaatggctacaggcgattgtccgcgtgctgaaatgagaaactccgaattatctccgtagatacctccacctacattaggaatagctcccactatatcggatttagtattggcatcagtccgtaacagttgcatgccacggaaaggtgatacattaagacctttcaatcgtccttgcaatccggtaaggatggtggctgactgatattttatcaagtcgttggtataaaccgtcgaagatgctcctagggtattacttttagtgtgatccacactatctatcggtgcatcttgtgcctttagtgcgacggcagctatacatagtagtcccgtcgttatcattttatacatattctgtttcattatcagtagaatataaggttatcactcgcaatagaacgtatatatgaatggttccttctgcggaggaagaggtatatttaacattacgaagtcatcatcagactgtgtaacggagatagatccatcggcattagtgaaggcatattcaatacttacaagctctgttccttcaggtacattgaagaacccttccggccagaatgtgatattgtatgttttggtatactgattctctcgtttcatcagggtcttgtcactcttctcatttacggtataacggtgtccgtcgctagctaccgccgttccttcaaaatagatcttatcggccttgacaagtgcattttcgtcgtccatgcctccaatgaagctaaaggttacaaagtcgttttgcaatgctgttaatggagtggttttgttgaagtgttcactacagaagtcagtgacaagtccttcaccttctactacctcaaaacatccggcttcctcacatttctttgcatctgcacttgtactgaagttatcgtcagtactgttaataaagaatgatggtttgaaacgcagatttttgtttcctaccggtacacggacatagattgtaaaatgaatttcatctgcgacaccgttatagggtcttgtccaataggctgcccattccatatcttccagaatattggtaccgacaccgtattcctgcatgagagcagccgaccatgacaatcctggtttgttgctaggttgttcggtcaatgggataagcgtcatgttttgctcacctatattcggatcaaatgtatcttctgtgtacgaaactctggcattttgtgccagattccaactcttaggagccaaaaaaccgaaaacaagtcgtttgtcattgcgtgggtctccttgaaccttaatgtgtccatgcattttgaaagtagcagtcgttccggcctttgcatagtttacggcttttccatctatcatttgggttatatcgacagaatcgataaagaggcaactcataacgatgaaagtcataagtatagttgataacgctacgatgtgccgtttgcgttgaagcaagctgattaatttctttttcataaagcgttatgatttttagttttctgatattttcttgaatacataggtgtaggtattcgaaccacacccggggctatgagtaatcacgatgttacgttcgccattggtaatggggaataggatatcggtactggcctgctccgtggctccatcctctgtgaaatagaggcgaaaaggataatagatatcgtcaactttccacgtgccattgtggcgtaccacaaaaggcagatagttttcaattgtgtacttaccatctttcttcaggtcaatttggaactggctgaagtccatggtttcggtaatatcattactgttgcggctcactgtggtgagttgccacgtgcctgatatgtctttgacctgctccgtgtttttgtcaggatcagcaggagcagagaacgtatcacacgatgtcacaagcagagtagtcagcaaggctattgccgccaaatgtatgctatgtttcatatttagggtattttattaattatagtagggattctgtagcaaatctttcgacttcaccgtttcattgtaaggaattgggaagaagtacatagccggacgccatacatgcgtgcgtacatcaaattctttccaagtctttgttccgtcagtggcgcgagtgatttcaatgccatgcatggttttgctttcggtttgcggagcaatcatccagcggcgtacatcaaagaagcgatgtccttcaaaagcaaattcaaggcggcgttcttcctgaatggcttggcgcatctgtttttgtgtcatattctttttaagtccatacataccatctgcaccgggctcgatgccggcacgcttgcgaatgagttttaatatgggatagcaaccaagttgttgtccgcctagtgtttcttcgaaatcgggcccatgatattcattggctgcttcagcatacatcagtaaaatgtcggcgtaacgtatcagtggatcgttgtgacggcttgggttccatgtactacctttacataagcgatcacatcccttgcgtacatagaaaccagtggcagtgccttggtatacggcatcgcttgtttgccctacgccaatccatgtgttaacaactgtggtagcactgtaagtatcgtcagcagggaccaaagcaccatcataaatcacggtgttgttgaaacgtggatcacgattttgagcgggattcagaggatcgaatgtgtattggctgttgttaatgggtttaccgtcaatcatagggaaggcatctgccaattctttgtatatgtacccgccgtggcgtgttccggagtgacttccactaggtggatagtaagcagcttcatgtccggactcacgttgatacttacggtcgaggatattgccggcaaaggctccgttattgtttttaccatcatcatcggttaaattggcatttcgtgtatcaccggcttggaatacgacgtagaatccgaaacctggttcggctttgccgttcaaatctttacttctaataaagagattataggttcctaggttgattactgcgcgggcagcatccattgccgttttccaacgttctttatcataagagggatagcctactaattctttggtatcagtaggagcgaaatcacttccattgaataatggactagctgcatagaggcagacacgggctttaagacccaatgccgctgccgatgaggcgcgaccgttttcttgacctgttcgtcgcacgggaagtacattgagttggacgatagagtcacattgatgggacacatactctacacattccgcccatgtgttgcgcgaggttttcattgtcgaagtagcatcatacacgttattaccgataataggtacaccaccgtagtgtttcatcagaatgaagtagtaccaggcacgcaagaaaagtgcttcggatatgtattgagctttccggctctgtaccatcggtgatcggtcgatgttggcaaggaatacgttacaccggcgaatgttagtgtagcatttcgaccatgcatcatcactcaccgtaaccggattaaccgtaccggtagcaaacatcatgtttgtccagatggttgacgaaggataaaattcagcttcgtcacaagcgctttgcagcccaccaccattagccaaaaggtatgtccatcggttgtagttgatatcaaacccgatatcggtataaattccggtcaggaagttggcggtatacgtactatctgcaaaaacggtctcacgatttaaatccgaagtttgggtttgatcgaggaaactgtcattacaggacgcaactgttcctaaaaataggagtagcgttaatgatttcatgtacaatttcatagtaaaacttataaaattaaaattaaacaatttaaagccaataagccgagactaattcacgacttgaatttgtattaagacgattgacaagatatacaccactaaacacaatacttttttttcacgtattattattcagtgaaaaggtcattgtattattcgagcaatgatagtaaatcaaatacatctaaagaaagaattatccgaattagtggtttttcattcctgaatcgtctttatcctaaactctaatagtataacattatgagacgcatctttttgtcaacctttatggcttgtattatcggctttacaggtgcagaaacaaattaaataatcttaaatatcttattaaacatgaaaccaattcatcttatcctaagtatcgcactcctcgccggaggagcatgtggtgaccagcaagaaccttattacggcaattcagaagtgaagatgcctcaaattgattccgaatggaatctcgaactaatgccaaatcgatcaggacaatattggaaagtgttcgtctacaaagacttgaaatacaatgcccttttcactcggtcgttgggctggaatggaggagacggtgtgttcaccactggtttgcctgacgggaatatattttggtcgttcaatgatagcttctatggcgtaatcaatgaaaatcgttcacgaggtaattgtagtttccctcgtaacagtattatggtacaaacacctggtgagaaggatgaaaatcttgtttggttagctgattacgtacaaaccaacgatcctaatgcggatagatactatcaggtacgtactcacattcgtcatccgaaagctacactatcggatgaaaaaatacaagctggagaaatcgatcaggattatctttattgggcaggagatgctacgatatataacaatcagatgcaaatgttgtggggagccgttgataataccgatccgaacaacttgatgcgccgctttggtacttgcttggctacttatagcttggaaggaaagccgggtgatgctacttatatgaaacttatcagtcgtaatgataattttaacgaccacactttaggttatggcgacactatgtgggaagacgaagacggacatatctatctttacacaacttccaattataaggtggctgtggcacgtaccgctacacgcgaccttggcagccagtgggaatattatgtggccgatccgcaaggacatttctcgtggacaacgcagtacccctcaacccaagatgctgaaaattctacaattatccctttggaaagtgcatgttctatgccttgggtatttaaaaaaggtgatacctactacatgatcggacaatccatgtggttcgggagagacgtgctgatgttccgtagtaagcacccttatgggccgtttgtcgaccaaaagactctctttacattgcccgaatttcttgataagattggcgaacaacgttatcaacatgtttatatggtaaatattcatccggctttatcacgtaccggtgaattggtgatctctaccaatacagactgttccaacttttgggataatttcaatgcaccgggtagtgctgacttctatcgtccttatttctaccgtgtatttaattgggaatcattgtacgataacgatgctccacttgagtaaaaggatttactatctctgacgttgatcataagtttcattgggctgatgctgtgattgatggtaattccatcatcgtctcatctcctgaagttgctttcccaatagcagtgcgttatgcttgggcagataatccaatttgtaatttatacaatggagttaaccttccggcgtcccctttccgtacagatgactggcagggtattcttatggtaataaatagatatagttgtttcgatttgccaagtgaaatagatgtaacacataaaaaaataaccatgaacaagctcatttatttagtaattttctctttcttatcaacaagtatatatgcccaaatgaaagaccttgtgcaatatgtcaatacactgcaaggtaccgactctcatttcggattaagttatggaaatacataccctactaccggtatgccttatgccatgcatacgtggtctgcccaaacagggaaaaatggagaaggctggaaatatcaatatgcggtagataatatcagaggattctgccagtctcaccaatgcagtccgtggatgagtgattatgcagtgtattcctttatgccgatggtagggaagttagtcgttaatcaggagatgcgggcaacgaagttcagccatgataatgaaattgccaagccgcattattataaagtgatgctggataatggaattacaaccgagatggctccaactactcgtggtgtacatttacgcttttcttatccctctaccgaagacgcctatctggtaattgacggatatacggatatgagtgaaattaagattgatccggcaaagagacaaatctccggttgggtgaataaccaacgttttgtaaataactctaagacattccgtagttactttgtagtgcagttcgacaaagcatttgaggattacggtatgtgggaaaatcagaaagatgagatttatcctaaaaagttggaaggagaaggcaaaggctatggtgcttatatcaaatttaagaaaggatcgaaagtacaggcaaaggctgcctcttcctatatcagcgcagagcaggctgtgattacattgaacgacgaactgggtaaagataagaatttggaagccaccaaaatacgtggacataaaacgtggaatgaattattgaacagaatccaggtagaaggtggaacagacgaacaaatgaagactttctactcctgcctgttccgtgccaatctcttctcacgcaaattctatgaacgtaaagcgaatggagaaccttattattatagtccttatgacggcaaagtatatgatggatatatgtatacagataatggcttctgggacactttccgttctcaatttccattaactaatattcttcatcctaccatgcagggacgttacatgaatgccttgcttgccgcacaagaacaatgcggatggttaccttcctggtcagctcccggagaaacaggaggaatgttgggtaatcactccatttcattattggcagatgcgtgggcaaaagggattcggacttttgatccggagaaagccttaaaagcatacgcgcacgaagccatgaataaaggtccttggggaggtgccaacggacgtggtttctggaaagaatattttgaactgggatatgttccttatccggaatcaatgggatcgagtgcacagacaatggaatatgcatacgatgatttctgtggctaccaactggctaaaatgaccggaaacaaacactatcaggaagtctttgcccgtcagatgtataattataaaaacgtattcgatccgtctatcggttttatgcgtggaaaaggcgttgatggtaaatggcaggaaccgtttgacccattggagtggggtggacctttctgcgaaggtaatgcctggcattatacctggtccgtattccatgatgtagaaggattaatagacttgttcggaagcgaccaaagatttacgaccaaaatggattcggtattcacccttcccagcactattaaaccgggaacttacggaggagtgatccatgaaatgaaagaaatggaattgtcgggtatgggacaatatgcacacggcaatcagccgattcagcacatgccttatctgtatagctatgccggccaaccgtggaaaacccagtattgggtgcgtcagatcgttgaaagattgtataattccacagaaagaggatatccgggagacgaagatcaaggtggtatgtcatcatggtatatcttgagctcattaggcatttatgccgtttgtccgggtacggatgagtatgtaattggcagtccgttatttaagaaagctactataacgatggaaaacggtaataaattcgtgattgaagcgaacaacaatagtaaagagaatctctatatccagtctgctaccttaaatggacgtgtgttggataagaattttatcagatacgacgatatagcagacggaggaattatccgttttgaaatgggaagtcaaccgaataaagaacgatgtacgtcgaagtatgccgctcccttctcattgtcgaaagaataagaaactaaaaagatataagaagaatacagtatgaaaaataaaattttaacaggtttattattggttttgattggagggtgggggagtctctcggcgcagagcgccgggagtaattatgcccgtcaggtaaataccctgataggaacgaagggcgtgggtttgacttcgggatatctttatcccggagccacctatccttatggaatggtgcagttcactccctcttatttttccaaacgttccggattcgtcatcaatcagttgagtggtggcggttgcgagcacatgggtaactttcccacttttccggtaaaaggtaaactgaagatgtctccggacaatattctcaattaccgtatcaatatttctgaagaaaaaggacatgccggttattatgaagcaaaggtgcaggaagatattcatgcaaaactgacagtaaccgaaagaaccggtatggcgagttatgaatatccggcagatcagcaatatggtacggtaattatcggtggaggcatttccgcaactccgatagagcaggccgccatcgttattactgcaccgaataagtgtgaaggatatgcagaaggcggtaatttctgtggactccgtacaccgtataaagtctattttgtagcagagtttgatacggatgcgttggaatcgggaacatggaaaagagatgaactgaagccgaacacgacttttgctgaaggagaatactccggagtctattttacttttgatgtaaataagaagaaaaatatccaatataagattggggtttcttatgtatcagtagaaaatgcacgcgagaatctgaaagcggagaataccggatgggatttcctgcagattcagaatcaggcagaatccaaatggaatcattatttgggtaagattgaagtagaaggaaccaatccggatcgtaccactcaattttatactcatctgtatcgttcattcattcacccgaatgtatgcagcgatgtgaacggagaatacatgggagctgacttcagagtgcataaatcccgttccaagcactatacttcttttagcaactgggatacctatcgtacacagattcaactattatcaatccttgatcctgaagtagcctctgatattgttatttctcaccaattgtttgccgaagaagctggtggtgctttcccgcgttgggtgatggctaatatagagaccggcgtgatgcaaggagatccgactcctatcctgatatccaatgcttacgcttttggtgctcgcaattatgacccgaaaccgattttcaaaaccatgagaaaaggagcggaagaaccgggagcaatgtcacaggaggttgaggctcgtccgggcctgaaacagtatttggataaaggatattacaacgcttctatacaattggaatatacttccgctgattttgcaatcgcacaatttgccttacatgccgtaggagatgagtttgcaagctggcgttatttccattttgcacgttcatggaagaatctgtataacccggaaaccggatggttgcaatcacgcaatcccgatggttcgtggaaaccactgactgaagatttccgtgaatcgacctataagaattatttctggatggtgccatacgacattgccggtctgatagaaatcattggaggcaaagcagcggcagaaaaacgcctggatgaattctttactcgtctggatgccggctataatgatgcctggttcgcttccggcaatgaaccgagctttcacattccctggatatacaactgggtcggaactccctataaagcacaggagattattaaccgtgtattgaatgaacagtattcaagtaaaattgatggtttgccgggcaatgatgatttagggacgatgggcgcctggtatgtgttcgcttgtatcggtctttatcccgaaataccgggagtgggaggctttacggtgaacactccgatattctcatccgtgaaagttcatttaaagaaaggggatatggtgataaaaggcggttcggaaaagaatatttatatcaagtccatgaagctaaacggtaaaccgtatgacagtacatggatcgattgggatcaactgaataatggggctacaatagaatacactacttcgtccaagcctgacgtgaagtggggaactaaagtgacgcctccctctttcccttaaagcaaatcaacgaggtatataaatttatgatataagataattttgtaagagcacttatttataacatcaaacgtgaaaatgaaaagaaaactacaaaacatagcttatctactgatggctgccgcattaatcacttcctgtggcgagaagaagcaaacagcagaattcccggattgggcgtgggcagatttccagcgtccggaaggaattaatccgattatttctcctgacactactacctttttctattgtccgatgcgacaggagtcagtagcatgggaagcgagtgatacgtttaatcccgctgctactgtttatgatgggaaagtagtagtcttctaccgggctgaagacaactcggcaatcggtatcggatcacgtacctcccgtttgggatatgcctcttctgacgacggactacacttcaaacgaatgtccgtacctgtattttatccggcagacgacagtcagaaagaactggaaaatcccggcggttgcgaagacccacgtgttgctgtaacagaagacgggctttacgtaatgcattacacacaatggaaccgcaaacaggcacgtttggcagtggccacctcgcgcgatcttcaaacgtgggaaaaacatggaccggctttcgcaaaagcatacaacggaagattcatggatgaattttccaaatctgcctctatcgtaaccaaattaattgacggcaaacaagtgattgccaagattgacggcaaatactggatgtactggggagaaaagtttgtgaatgtagccacttccacggaccttgtcaactgggaaccgatgttggatgaaaatggagaattcctgaaagtgatgactccccgcgcaggtaagttcgacagtgacctgaccgaatgtggtcctcctgccatcctgactgacaaaggaatccttttattttataacggcaaaaataaatcgggcgcagaaggagacacactgtatacagccaactcttattgcgccggacaagccttatttgatgccaaagatcctactaaactaatcgatcgcttggataaacctttctatattcccgaatcagactttgaaaagagcggacaatatccagccggaaccgtatttatagaagggcttgtattccacaatcagaaatggttcttatattatggctgtgccgattcacgcgtggcagttgccgtatatgatcctctcaaaaaataaagaaaacgttcataatgaaaataacagtttataaaatagaaattaagacatgaaaaaactttttgtattgattgcagcggcttgtatgacatgtactgctgcgtttgcacaaactgtgaaaccttttaaggagggtgagagagcagtgttcctgggaaatagtataacggatggtgggcattaccattcatacatctggttatattatatgactcgttttccggatatgcctatccgtgttttcaacggtggtattggtggagatacggcgtatgatatgaataaacgcctggatggtgatatttttgcgatgaaaccttccgtgttgatggttacttttggtatgaatgattccggatattttgaatataacggtgataagcccaaagaattcggtgagcagaaatatcaggaaagtataaagaattaccagcagatggagaaacgttttaaagatcttcctgatacccgtatcgtgatggtcgggacttctccgtatgatgaaaccgtacaactcaaagagaatacaccgttcaagacaaaaaatgaaaccatcaaacggcttgttgaatatcagaaagaatcggcagctaagaataattgggaatttaccgatttaaatgctcctatgacagctattaatcagcaatatcagcagaaagatcctacctttaccctttgtggcagtgaccgtattcatcccgataacgacggacacatggtaatggcctatcttttcctgaaagcccagggatttgtaggtaaggaagtagcggatatggagattaatgctaataaaaaacaagccgttaagtcggaaaattgtaccgtttcaaatataaagaagaatggaaaagatttgagttttgactatttggcagaagctcttccttatcctttagatactattgctcgtggttggggacagaaaaagagccaggcagaagtgctgaaagttgttccttttatggaagagatgaaccgtgaaacgttgaaagtaacaggactaaaaggcaattataagttgttgatagacgatgaagaaattggaacttggagtggagatgaactggcaaagggcattaatcttgctgctgaatccaaaactccccagtaccaacaagcattgacggtgatgcacctgaatgaatatcgttgggaaattgaaagaacattcagagaatatgcgtggtgtgaattcggctttttccagcaaaagggattgttgtatgctgacgacagaaaagcgatcgaggtgatggatgaaaacttggataaaaacgtttggttgaagggacgtcgtgatatgtattcaaagatgatgtttgaagctgtccgtgatgctcgccaacaggaaatggatgttcttatcaataagatttatgaaataaataagcctgttgtaagaaagattttacttagaaagatatgatgcgataacaacgtacaaatacgatagaatactcaccgtaatgagaaagaattctcactgtaatgagaactttttctcattgcgatgagtattttttctcattacagtgagtatcgttgagaatatatgaatagataagtactctttgtaatagcttgataatgtatgtcttattgtagcttttgcattaaagagactacctttattgaattcttaattctttttccagaaatcggaagtgaaaagtagtaatactgtaaacaattccaaacgtcccaagagcattaaaaaagaaagcagccatttggcggcatcaggcaattgactccatgaaaaagccgggccgcatgtaccgagtcccggtcccatattacccatacttgagattacggttccgattgattccagaaaaccgactcccagccccatcatgataagtatgctgatgatagcgatgactgcatataaaaaagtaaaggccaatactgtagactggatggaaggagaaataacctgtttgttaactcgcaccgggagcacggcattagggtgaagaatatgtttgaattcgtttttcacaacctgaaacaggataaccatacgaatacattttatacctcctgttgtactgccggcacaggctccgatgatcatcactattacaaggcatccccaaagaatagaaggccaaagcatataatcggctgtggcaaatcccgtagaagtttgcaaggaaatcacttggaaaagtgatttacggaacgcctcttctatctccatagaagaagtctgatgaagccagactgcaataaatatagtaaagaaagagacacaccagaaatagaactttagctctgcatcatgaatgaacttctttatttttccattgaacatcaacagtaatagcgtgaagttgatgcccgaaagaaacatgaaaatagagattacataatctatatagggtgaatgataatattcgatacttgcttgtttggtagaaaatccgccagtgctggttgtcgtgaaagcatggcatatactgtcaaacacactcatacctccaaatactaataagacaatcaatgtccctgtcattccggcataaataccccaaatccatttggcagtgataccaatacggggatgcactttgtcatgagtaggaccgctggcttctgctgcaaacacctgaatcccacccacaccgaaaatcggcagaacggcaatggtgaagaatacaatacccaaaccgcctatccattgcgtcatagcccgccaaaaaagtattccatgaggcattgactctatattattcaagatggtggcacccgtactgctgaacccggacatcgtttcaaaaaatgcatccgtaacacttgggatataccctcctatataataaggtaacattccgaaaagggaaaaggtgacccatgctacactgactatgacatatccatcacggcgattcagggatttcactgcgtctttcccgatggcgagcaacagaataccgatgctagtggtaatagccgatgaaaccagaaaactctgcaagtcattctccttataaaaaagagaaacacccccacaacataatagcataactgtttctatcagaagcagaaaacccagaatccggaatatcatcttcgagttaatcatatacaagtatttgttgatacttagtgaaagaacttctcaatctttttaatcatcatgcttaagcagaatacgactacatggtcgccggggcggatttgcgtatcacctgtcaccaggataccttctccgttacggatcattcctccgatggtggtgcctttgggaagtcccaggtctttaatcaggtgtttggttattttggctccttccggtacggtgaattctgcaacgtccgcattggcaaaagttaggcattttacattagacacgtcggcgtccaacatcatttggtagatatggctggcagcaatcatttttttattgataaccgtgccgatgtcgagactctctgccataccgatatagtcgatgttctccacttctgccaccgtcttttccactcccatgcgtttggcggcgagacaggccaggatattcgtttccgagttgccggtcagggctacaaatgcttcggtattctttagcccttcttcgataagcaggtccatgtcgcgaccgtctccgttgataatcattgttttgtcatccagtagctctgtcagacggttgcaacggttcaggtcattatccactattttcacctgcatatagtccggcacatattgtgcggtacggactgcgatacggctacctcccataatcattacattgcgtacgtcggcatagtcttctttgccggctatcttacgtatataaggaatgtatttgcgggtagtggtgaaataaacaatatcatgcaatttaataacatcgtctccgcgagggataatcgtttccgttccgcgtttgatggctactacatggtaaggaatgttgggaccgcctaattggtgcagcggtatattcaggatttcagccttttcgcgcatcttcgtaccaatcagaaccagcgaacctccacagaattcccaccattggcgtacccagctcatgcgcatggaagatacgatttctttagcagccagcatttccgggtaaatcagcgaatctactcctagcttctggaaaaactctttatttttgggtagaagatattcatagttgtcgatacgcgccactgtctttttggctcccaggttggtagccagcatacaggcagtcatgttgcggctttcgtccggtgtgactgcgatgaacaggtcggcttctttgacgcccacttctttcaatccggagatggaagaaggagaagcggcaacagtcagcaagtcaaagttggcgctaagagcacttagtttctcttcgtcatcatccatcaagataatatcttgcttttcgcgcgataacagtttggccaaatgggtgcctacgttgccggcaccggcaataataatcttcatgtcaattgataaattcttttattttagtcagaatcccttcttcatccatgccgcacagttggtatagttcggcaactgccccatgttctacaaatatattagggataccgatacgcttcacggtcggtttgtattcgttgtctgccataaattcgaggacagcgctacccataccgcctttgataattccgtcttcgatggtcaggatacgttggaatttacgtcctgcctcatgcaacaattcttcatccagcggtttcaggaatcgtaaatcgtaatgggcgatggacagacctaaatctgcttctgcccgggtgatggcacgggcggctacgtttcctatcggtccgatagtaatcactgcaaggtcgctaccctctttcagtttccgtccttttcctaccggaatttcttccagcggacatttccagtccaccagtacgccgcgtccacgggggtagcggatcacgaacggtcccttgtccggcaattgtgccgtatacatcaggcgacgtaattcatgttcgtccatcggggaactgatagtcagattagggatcgggcgtaaacatgccatatcaaaagctccgtgatgagtaggaccgtcttcgccaaccagtccggcgcggtcgagacacaaaacaactgggagattctgaatcgctacgtcgtggatgatattatcatgcgcccgttgcataaaagaagaatagatattgcagaacggttgcagtccgtctttagccattcctccggagaaggtaaccgcatgtccttcggcaataccgacatcgaaagcgcgtttcggcattttctccattagtatattcatcgaacagccgctgggcatggcgggagtgacaccgacaatcttcgggttggcttcggcaagttccaccagtgtatttccgaatacgtcctggaaaagcgggggcattccttcggtgttggcaatgaaacgttcgccggtgacgggatcgaatttgccgggagcatgccattcggtagcgtgtttctctgccggtccgaatccttttcctttgatagtatgcaggtgcaggattttaggtccttgcatatctttgatatcacgtaatactcttgccaggttctttacgtcgtgtccgtctatcggaccgaagtaacggatattcatcccttcaaaaatattctgttgctgtgccgccattgatttcaggctatttccgaaacggatgagcgctttgcggcgttcttcgtttaaaatgccaagcttgaacagcatgcgcgagagcttgaaacgtagctgattatagcggttggaagtcgttaagttgaaaagatactgcttcatgcctcctacgctgcggtcgattgccatatcattgtcattcaggataatgagcaggttgttcgacgtggcagatgcgttgttcagtccttcaaaagccagtccgccactcattgatccgtcgccgataatggctactacatggcgtttggcgtctcctttccgggcggctgcgacagccataccaagagcggcagaaatagaattggaagcgtgtccgcacgtgaaagtatcatattcgctttcttccggagacgggaaagggcggattccaccgagtttcctgtttgtggaaaatgcttcacggcgtcctgtaagaattttgtggccgtatgcctgatgccccacgtcccatacaatacggtcgtatggtgtattgtagacgtagtgcagagctacggttagttccacggtccccaggctggcggcgaaatgtccggggttgcagcagagttctttaataatgtcttgtcttagttcaccacatacttccggtagttgctctacggttagtttacgtaggtcttcggggtaattgatggagtttaacaagttatatgttggttcactattcatgattctaggaaatttagtgcaaaaatacgaaaagaaagtatattcgacctccttttttttataaaatcttatccggtataaagacgtatctgtttttctatgcttcctaagattattgaatcgtgaggaaaaagagggcggaaatagttttttgattacttttgcacatgaaacgtaatgaaatgatggaaaatcgtatgaactttcaaacatctgtagaattacctgccgggatgccgtcggtcagtcatgcagatcatattcttctgatggggtcctgttttgcggaaaatatcgggcgacaattaatggatgccggatttcaactggacctgaatccttttggtattctttataatcctttgtccgtctcatctgctttgagggagattataagaaataaggaatacaacaaacaagatctgtttgcctacaaagatttatggcatagcccgatgcatcatggctctttttctgcttttacgcccgaagagacattgcatgccataaattcacgtcttcaccacgcttataaaaaactgccggaattgaactggctgatggtgacaatgggaactgcttacgtttataaacaaaaggagagtggacaagtggtagctaattgccatcaattgccggagagtcactttttgcgttaccggctgtctgtagaagaaattgtagaagattatacagcactcatcaccgaaatgtcagcccggaatccggatctgaaatggttgtttacagtcagcccgatccgtcatatacgcgacgggatgcacgccaaccagttaagcaaatcgactctgctgctcgccatcgaccgattgcaacaactgtttccggaacgagtgttctatttcccctcttatgaaatcatattggatgaattacgtgattatcgcttctatgccgatgacatgttgcatccgtctcctctggcgattcgttacctgtgggaacgcttctccgaaaccttcttttctcctgaaacaaagcaggttatcgtagctgtgcaagacatccgccgggacttggcgcacaaaccctttcatcccgaatcagaggcgtatcaacgctttttaggacaaatagtgttaaaaatagaacgacttatcggaaaatacccgtacttagattttcaaaaagaaacagaactatgtcatatgcgattgaatccatagccaaaagtatcggtgcccgccgtgtgggcaaacataaagcgactattgattggctgctaacagacagccgctctttgagttttccggaagaaactcttttttttgctttaactaccaaacgaaacagcggagcccgttatatccccgatttatatgaccggggcgtacgtaattttgtaattacggaagaagactttaaagaagttgagaatggagagttgagagttgagagttctatgcagcatgatggtgcgcagcccactctcaattctcaactctcaactctcaacttcctcatcgttcccaatcctctgaaagctttgcagaagcttgctgaaacacatcgtgataaatttaaaatccctgtgattggtatcaccggcagtaatggaaaaaccattgtgaaggagtggttgcatcagttacttagcccggatcgttgcatcgttcgttctccacgcagttataattcgcagatcggagtcccactttctgtgtggcaactttctgaagaagccgaactgggtattttcgaagccggcatttccgagatgggggagatgggagctttgaaacgaatgattaagcctaccattggtattctgaccaatatcggtggtgcccatcaggaaaacttcttctccttgcaggagaaatgcatggaaaagctgacgcttttcaaagactgtgatgtcgtgatttacaacggtgataacgagttaatcagtaattgtgtcgcaaaatcaatgctgacggcgcgtgagattgcctggagccgtaccgacattgaacgcccgttgtatattagccgtgtgaccaagaaagaagatcataccgttatatcttatcgttatctggagatggataatactttctgtattcctttcatcgatgacgcttccattgaaaatgcactgaattgtctggcagcttgtctttacctgatgacacctgccgaccagataaccgagcggatggcccgtctcgaaccgattgccatgcgtctggaggtgaaagaagggaagaataactgtgtactgattaatgatagctacaattcagacctggcatcattggatattgctctcgatttccttgtacgccgctcggaaaagaaaggcttgaaacggacgcttatcctgtcggatatactggaaaccggacaaagtaccgctacgctttatcggcgtgtagcacaattggtacagagcaaagggattaataaactgattggagtagggcaggagatatcttcttgttccgcccgttttaatgatgatctcgaacgctatttctttcctaacacagaagcactccttgcatccaatatactcaaatcgcttcattcggaagtgattttggtgaaaggttcccgcgtgttcaactttgatttggtatccgaagccctcgaattgaaggtgcatgaaaccattcttgaagtaaatctcggggcgatggtagccaacttgaaccattaccgttctatgcttcgccatccggaaacaaagatgatctgtatggtgaaagcatcagcttacggagccggttcgtatgaaattgccaagagtttgcaggaacaccatgtcgattatctggctgtagccgttgctgacgaaggttccgaactccgcaaggcaggcattaccgcctctattatcattatggacccggaacttaccgcattcaaaaccatgtttgattataaactggaaccggaagtctataatttccatctgctcgacgcacttatcaaagctgcggagaaagaaggaatcaccaacttccccattcatgtgaaacttgatacaggtatgcaccgtttgggctttgcggtagaggatattccattgcttatccgtcgactgaagaatcagagcgcggtgattccccgttcggtattctctcattttgtaggaagtgattcgtcacagttcgacgctttcacccgcggacagattgaattgttcgagaaaggttcgcaagaattgcaggccgccttctctcataagattctccgtcatatctgtaatacggcaggaatcgaacgtttccccgaagcacagtacgatatggtgcgcttgggaatcggactttatggagtcagcccgatagacaattcgataatacataatgtaagtacgctcaagactaccatccttcagatccgggatgttcctcaagaagatacggtaggatatagccggatggggcatttggtacgcccttcacgcattgcagctattcctatcggttatgcggatggactgaaccgccacttgggacgcggcaacgcctattgcctggtgaacggaaagaaagctccttatgtagggaatatctgtatggacgtttgcatgatcgatgtgacggatgttgattgtcgggaaggcgatcaggctatcatcttcggtgatgatctgccgattacggtgttgtccgataagctggaaacgattccttatgaagtgttgacaagtatatcgacacgggtgaaacgggtatattatcaggattaattcaccacagattacacggattcacacagattgaagagaatatatagtagcaataaatcgaaagataagctataaatctgtgtgaatccgtgtaatctgtggtgaaaatgattatatttgcagcaactattaaaaacctcttatatcaaataaacttatgacaaacttattattgttaggctttttgcccagtggttccgaatggattattatcgctttggttatccttcttctttttggtggaaagaaaattcctgaattgatgcgcggattaggcaaaggcgtaaagagcttcaaagacggtgtaaacgaagcgaaagatgaaataaacaaggctaaagacgagttggacaaacctgtagatccttctaagaactaaaagagcacaacatacggatggcagaaatgaccttttgggatcatttggacgaactgcgtaaagtactttttcgggtagttggagtttggtttgtattggcaataggctattttattgctatgccctacctcttcgaccatgtaatacttgcgccttgccacaatgatttcatattctacgatttattacggcatatcggtaaaacatttgatttgaccgatgacttcttcacgcaacaattttatgtgaagctggtcaatatcaacttggctgctcctttctttattcacatgtcgacagcattttggatgtcggtggtgacggctatgccttatatcttttttgaaatatggcgtttcatcaatcccgccctttatccgaatgagagaaagggcgtgcgtaaagcattgactatcggaacactgatgttcttcatcggtgtactgttgggctactttatggtttatccgttgactctccgtttcctttctacttatcagttgagttcggaagtggagaatatcctgtcgctcaattcttatatcgacaattttatgatgctgattctctgcatgggattggcttttgaacttccattggttacatggttgctttctttaatgggagtggtcaacaagtccttcctgcggaaataccgccgtcatgcggttgtcgtcatagtgatagctgctgctattattactccgacgggcgacccgttcaccttgagtgttgtcgctattccgctttatctgttgtacgagatgagtattttgatgataaaggacaagaagaaaacagaagaggaagttgaagatgaagctggagatgaagttgccctgtccgaagagtgaagcgatagaatcttatgaaatccttttagcagtttgccgggcggaagatgcttatcttgccgtaggatataagcaaatgcgcgacttgctggagcgtatttgtcgcgcgcaaatgcaaaacgaaagtttacagatgaccgacctttccgcacgaatcagtttcgtggcggctaaggtcggtctttctgttgcagagcagaaccggctgcatactttccggctcacttcgaatgctatcttgaaccgccagcaggagcccaaccgggaacaactcttgcgcgatgcgaaaacgttagctttctttattcgtaaactcctggaagaggatattcccatggaactataccggctacttccgcgtgcggatgctacctacctggttgcgtctcctgcccgcgaacgagtgcagcgaatgcgtgtctgcttccagtatgctgacgagcaatatttgtatgtgactcccttggacgaagtctcggagaaaccatatttagttcgttataatatccctcaaataaatgaagagtttgcagaaacgtgcaaattgctttggcgtcatgcccaggtcaatttattggatgttgcagtggatgagacaggaatcctgactccttctttcattgtactcgaaccggattatttacttgacatcagttctttggcagagtgtttccgtgattacgggcatcatccggccaattattttctttcccgtcttcaaccgatcgaaaatgcccggcctctgttactgggaaatatagccaatctttttctggacgaatggattcatgcgaagagtgaagacatagattatcgtacctgtatgcagaaagccttccggcgttatcctattgagctggctgcctgttccgatttgcgcgacaaagagaaagaacgccaattctttgaggactgcaaactgcacttcgatcatattcgtgaaacggttaatgatacctttcatgcagccggttatgaactggacaagacagatgccgtgcttgaaccgtcttatatctgtgaagcactcggacttcagggacgtctcgactatatgcagcgggatatgtcttctttcatagaaatgaaatccggcaaggcggatgaatacgctatccggggcaaggtagagccgaaggagaataataaagtacagatgttactttatcaagcagtcttgcaatattcaatgggaatggatcaccggaaagtgaaagcctatttgctttatacccgttatccgctcctttatccctcccgtccttcgtgggcgatggtacgtcgggtgattgatttgcgtaaccgcattgtggccgatgaatatggcgtccaattacgcaatagtctggaatatacggcacaaaaactggaagaaatcaatgcctccaccttgaatgaacgaggattgaaaggacgtttttgggaaacatacctgcgtccctctattgataactttcaatcgaaactgaaagctctttctccactggaaaagaattacttctatgcggtgtataactttattacaaaggaactttatacctcaaaatccggtgatgtggattatgaaggacgtaccggggcagcttctttatggctttctacattagcggagaaatgcgaggccggagaaatcatttatgatttgaaaataaaggagaatcatgcggccgatgaacataaagccggacttactttttctttctttaaaaaggaaaaggctggggaaactttgttgaatgaggctaccataaatgacattactggagataaagctattggaaatgacattaccggagataaagctattggaaatgatattcttggaaatggagcctctgcaagtaagactgtcagaagtgaagctcttgaaacagagacttctctacctaatttccgtcaaggcgatgccattatcctttatgaacgtaaccgcgatacagataacgttaccaataaaatggttttcaagggtaatattgaatacctgacagaaaacgaaataggtattcgcttacgtgctacccagcagaatccatccgtacttcctgccgaaagcctttatgcgatagaacatgatacaatggatacaacattccgctcgatgtatcaggggttatatatttatctttctgcaaggaaggaacgccgtgacttgttgctgtcacagcgtcctcctcggtttgatgaatcattggatcctatgatttcccgttcggaagacgattttacgcgaatcgccttgaaagcaaaagccgcacaggattatttccttcttatcgggcctccgggaacaggcaaaacttcatgtgccctgaagaaaatggtagagacttttcatgcagataaagatgcgcagattcttttgctttcatacaccaaccgggctgtcgatgagatatgcaagtcgctggcttccattgctccggctgttgattttatacgtgtgggaagtgaattatcatgtgatgaagcctaccgcgggcatctgattgaaaatgaattatcctcttgtaaccgtcgttcggaagtgtacgaacgcatccggaattgtcggattattgtgggaacggtagcggctatttccggcaaaccggaactgtttcgtttgaagcattttgatgtagccattattgatgaggctacccaaatattggaaccgcagttgttgggtatcctctgtgcacgtggagaagacggaaaagatgcaatagataagtttgtcttgatcggagatcataaacaactgcctgctgtggtacagcaaaatacggagcaatcggccatttatgatgaatctttactgtctatcgggttgaccaatttgaaagattccttgtttgaacgcctctaccggaactgtactgcaacggttcatcgctcctacgatatgctgtgccgtcaagggcgaatgcatccggaagttgctttgtttgctaatcgtgccttttatggagggcgtctgatccctgtcggcctacctcaccaaatagaatcatccgataccatttgtcgtttggctttttatccctctgtgccggagaaggccggaacatctgcaaagatcaactattcggaagcacgtattgttgccgacttagctgctcgcatttatgaagatcatcggacagattttgacgaatcccgtactttagggatcattaccccttaccggagtcagatagcattgataaaaaaagaaatagaatcattaggtattccagctctgaaccgaattctagttgacacagtagaacggttccagggaagcgagcgtgatgtaataatctattccttctgtgtcaactacccttaccaactaaaatttctatccaatctgacggaagaagagggtgttttgatcgaccggaaactgaatgttgccttgacccgtgcaagaaaacagatgttcattacaggagttcccgaactactcgaacgcaatccactctataaaagtttattaaaattaatagaaagcttctgaaaaattgcatcattttgcagatgttagtttttattctctctttatgcaattcattaacacctctatgttgaacaaacgtctatatttgcaacacgtttttttcatagagatttagatttaaggttagaagaattgtggaagtcgtgagacttccctttttttcatcttaacgtttactatacttcattataggaatgcaaaaacactgtttctagtgtttcggttaaaaattttgcaggaggatgatgcaggataagtaaacctaaaaagccttcttcgtgagaagaggcttttttattttttcatttttcatttttttgaataattggctaaaacaaaagagtaactcggcgacgagttactcttttgtttttaatgattctatctgttcgaatagatttactctaatacgataggtttgtatttcggaactaatgccttcatgataacccaacccaacagataagctactgcacatacgcagaagataacgaaatatccggctggtttgccttcgaatcccatgaatgtcatggctgggtgtacgaattgtgctccttgttcgagtaattcttttgtcatttccacctctttgccgtcgatcatcgttgttccggaagcatatacgaacaagttacctgccactttctgaagaatcatagagcctacgcctcctgccataccacctataccggtgatacttgcaatagctgttcttgggaacatatcgcctacggtagagaatatattggccgaccaggattgatgagcagctccaccaataccgattaagataaccgggaaccatggagaaacagtacctaacggttgtgctaacagtacaaccagcgggaagaaggcgaagattagcatcgctttcatacgggctgcatacggattcatacctgttctgttgatgaagatagtaggtagtttaccaccatagatagataacatagtcactgcataaagcgtaaagatcaacgccatacccagcgggtcggaggttttgataccgaattgtgtattcagataagacggagtccagaaaaggaagaaccaccatacgccgtcagtcatgaacttaccgaagacaaaggcccatgtttgtttgtagctgaaacattgccagaacttcattctcttttcatctttctcgtctgtcattggagcactgcctgcttcgcgattatcttgctcgatgtagtcaagctctgcctgattgacatgtttgcttttcgacggggcatcatacataaacacccagaatcccatccagataaagccaagtccaccaattacgataaatgccatttcccaaccgaacatttttgccagaataggaatggtaagaggagcgatcaatgctccgatagatgcaccggcattaaagatagaagtagcataagcacggtcttttttagggaagtactctgcagttactttaatagcagcagggaagttaccggcttctcctaaagcgagaatacagcgggcggcgaggaagcagtacatactgaccgtagcaatagtcactaccacatctcctgtggcaccggccagttctgctgcactatgaagtccaacttgtgcttctgtgacaataccacaaacggcatgaagacaagcacctgccgaccagacaccgatagcccataaaaatccttttttagttcccatccagtcgacaaaacgaccggcaaacagcatacatatagcgtatacaatggagaaaacagaagtaatagtaccgtagtgagattcgtcccagtggaattccggtttgataaattcatcccacgtcaatgagagaacctgacggtcgagatagttaactgtagtagcaaaaaatagcatagcacagatggtccatctgtagtttgtcatcttttcgcctgttttttgaaatgcattcatgataatggatttaaatagattttgtttcgttgacaaaggtcggtatttcgactgaattttatttgtaaaaattggtcaaaatcatgtattattcgttgcattatatatgctatttgtttcaaaggatataaaaatgtctcatagcattatcatttgcaacgttgggggtaatacagaaagaagataaacgagtttgtgaatcaagagcaaatgagtctaatcttttagacgcagatgacgcggataatgcggattcttattttttgatccgtgctatccgcgttatctgcgtctgaaaaattatatgtcatacaggaatacgcaacggttagcgcatttctgtatatttgatcttgtccatgtctccgtaatcgaggttttcacctgccataccccagataaacatgtagttgcttgttccggcagcagcgtggatagaccattccggtgacatgatagcttgttcgttctgcatccatacgacgcgttcttcttgaggttcgcccatgaagtggcagatagcatttcctgccggtacattgaagtagaagtatgcttctacacgacgagagtgagtgtgtgccggcatggtgttccatacgctacccggtttcagttcagtcaatcccatttgcagttggcaggggccttcttcaagtacgttgttaacaatcaactggttgataacgcggtcgttgctttcttccagctttccggcagcaaatgagtttgctttcagagaacctttacgtccgtcgatagtaatcaattgagtcttgtattccttgtgggcagtagccgagttgatgtagaatttggcaggattgctggaatctttgctcttgaaagtcactttctgcttgcctctacctacgtacagggcatctttgaatttcagcgtatattctttaccgtctacggttacgataccttcgccaccaatgttgatgacacccagttcgcggcgttcgaggaagaatttagatttcaacgggtcgattgtttcaagtaccaattcttttgtcgcaggtactgcgccaccgaagatcagacggtcgtacatagaataagtaacgttgatttcgttcggaaccattactttttccatcaggaagctactgcgcaagcggttagtatcatacgttttcacgtcttgcgggctgcaagccacttgcatcttgtaattcacctgggcggaggcagacattgctgcgatacccaacatcattgcaattgctaattttttcatctttcgagttttttattgagttatatattatataccacttattattatcagttaaaggcttttctacttattccttattactgttcaatgcgttctttgcgtcgtttctagtcatgcggatacggttgtagatagccattccgagtgccagtgccacgaggatggcagggccgataatcttcagactgtaagtaaggtggaagataccccagcagaagagactggaagcaaagtcaagtgcgccgccttcaaaaccggcggggatgtttactgtcgggtcacctgttgcttcgtatacatctttagcagccagtgtgaagaagcctgccagtcctgttacgaaatacagacctacaatcaatgccaccaggccgataataaatgatttcactacgttaccttttgtaataggcagaatcatcgggaacaggtagaacatacctgccagagaagccagcggtaagaaacggttgcccggaaggataacagccaggaagatagtgacagggatcaacagcagagataccaccagggtagtcgggtgaccgataaccagtgcagggctcataccgatgctcaaaccggtgttattcttatatttcttagcgatcagttcgcgggtagcgtcagagatcggtttcaaaccttcgataaagaggctggtgatacgtggaatcaattccatcaccgcacccatcttgatacccagtcctaaaatgcccggaatattatccaatacttctttccagctggcacaacccaatgcgcctataccgcaaccgattacgatacccaagaacagcggttcacccatcaatccgaatttctttttcataccttcagaatcaatattcagtttgtcgaatcccggaattttatccaatagtttattgattacaatagcaaacggaacgaaactttggcagaacggttgaggaatagagataccgtccattttatcatagaacttttggaaagcaggagcagtcatatcagccattaccagcgtaatgatgtagcagatgatagcagcgaagaatccccaatagatattgtcggaagcaaagtaaacgatagcaccgataaatgcgaagtgccaatagttccaaaggtcgatattgacggtacgggttgttttggtaagcaacattaataagttaactcccaagcaaacagggatgatgaaagcaccgactgaagtgttgtaagctaccgccgcagcagaaggccaacccatgtcgaaaattcccaattccaatccgtagatttcaaccattttacttaatgccggacccagactgctggtgagcaatgccgtcactactgataaaccaacgaaaccgacaccaaccaacaaaccgctcttcagcgctttgggaagtttaataccgatacatactcctaaaatcgtgaaaatgattggcatcattactgccgctccaagaccgataatgtacttaaatacttcttccattctgttctattttttctctgttttaatgataaattacctgtgtttccccagagggtattagttgtaaaccgtgccaaaagtaagaccttttttgctttcttccaaaacgaaactcttaatttatgagatattgcatcaaaaatggacatttttgacgtttgcgtgcacaaaattagtcgtttccgtgcacgaaaaacaaaaaatgcacctacttgactaaaaaatcccactgggtttggaggaaaaacactactttcgtaccgtgaaaaaagactatgttgaatccttaaaataacaaaccatgagacgaactcctttttataatttttttatagtggctttattggttacaatgaccgcttctgtatcggcacaacaggtagacagcaaacttccctggtctgtgcgactgactgaatcggaaatgatccgttaccccgaatcctggcagctcgactttcagccgaaactgaagtgggattattgccacggacttgaactgggagccatgctcgatgtgtacgacgcttatggcgacaagaaaattcgcgattacgccatcgcgtatgcggatacaatggtgcacgaggacggaagcattaccgcttataaattaaccgattacagtctcgaccgtatcaactccggaaaaatccttttccgtatctatgagcagaccaagaatcctaaatataagaaagcgctcgacctgctttatagccagtttgaaggacaaccgcgtaatgaggacggtggtttttggcataaaaagatttatccccaccaaatgtggttggacggaatttacatgggagctcctttctacgcggaatatgcattccgtaataatcttccgcaggactatgcagatgtaatcaaccagtttgtcacttgtgcccgtcatacgtacgatcctaaaaatggtctttatcgtcatgcgtgcgatgtaagccgcactcaacgttgggcggacccggtgaccggacagtcgaaacatacatggggacgtgcaatgggatggtatgcgatggcattggtggatgtgctcgaatttattccgcagcatgaagccggaagagattccctgcttgatatattgaataatgtagctgtgcaggtgaagaaacttcaggacccgaagaccggaggatggtatcaggtgatggatcggagtggtgataagggtaattacgtagaatcttcttgttccgctatgttcatttattcgctctttaaggcggttcgtttgggatatattgataagtcttatctggatgtggcattgaaaggctacaaaggattcctggataattttatcgaagtggacaagaacggattggtaaccatcaccaaggcttgtgcagtggcaggattgggaggaaaggtatatcgttccggcgattatgactattatattaatgaaactatccgcaataacgatcctaaagccgtaggaccttttattatggctagcttggaatacgaacgtttacaaaagtaatttccgacaatgaaaaggactatttttaaaggaatgatgtgtttgcttctactgggtgtgggagcaacatctgtttatgcacaacaacagcaacgcaaagacacattagtcgtggcacgcgacgggacaggggagtatcgtaacattcaggaagccgtggaagccgtccgcgcttttatggattatacggtgacgatctatatcaagaatggtatatacaaagaaaaactagtcattccttcctgggtaaagaatgtgcaattagtgggcgaaagcgcagaaaaaacgattatcacttacgatgaccatgccaatatcaataagatgggtactttccgcacctatacggtaaaagtggaagggaatgacatcactttcaaagacctgacgattgaaaataatgcggctccactggggcaagcggtagctcttcacaccgaaggtgacagactgatgtttgtcaactgccgtttcctgggaaatcaggatactatttatacaggaaccgaaggagcgcgtctcttattcacgaattgctatatcgagggaactaccgattttatttttggtccttccaccgctctattcgaatattgcgaactgcatagtaaacgtgattcgtatatcactgccgcttccactcctcaaagtgaagaattcggttatgtatttaaaaactgtaagctgacagccgctccgggagtgaaaaaagtatatttgggtcgtccgtggcgtccttatgcggcaacggtctttatcaattgtgagtttggtaatcatatccgtcccgaaggatggcacaattggaggaatccggagaacgaaaagacagcccgttatgccgaattcggaaatacgggtgcgggcgcagatacttccgggcgtgtggcatgggctaaacagttgacaaataaggaggcaatgaagtatactccgcaaaatatctttaaggaaagcagtaattggtatccttataaataaaaatacgtagggtttccgactgtttatgcagcttgaaattcttgtttccgggcttggctctttgctttccctagcttgaaactcccgttccaaggcaggaaactgcagtttccctatgtgggaactgtcgtttctctacgtggaaactagcgtttcttaccggggaaactgtagttcctatacgtggaaactgaatttgtctgcgtgcaaaataggattatataaggtgttgcagataaacatctgcaacggtatctgcaacagtatctgcaacgctgcaatcggttgattgcaagtaagatacaagcaaaacgttgcaggtggcagataaaaacaaaaaataaaactcgtaggaggggatgaagaatatgaaaacacttagggttaaaatggtagggctacttgcaacggctcttattcttttttctgcatttcgtgcagataaaccggtcatcactatctttatgataggtgattcgacaatggctaacaagaaaatagacggaggaaatcccgaacgtggttggggaatgatacttcccggattcttctccgaagacatacggatagacaatcatgccgccaacggtcgaagttccaagagctttatcagcgaaggacgctgggaaaaagtaatttctaaggtgaagaaaggagattatgtctttatccagttcggccataatgatgagaaagcagactctacccgtcacaccgatccgggtagtacttttgatgaaattcttcgtcggtatgtgaatgaaacccgcgccaaaggtggaattccggtattgttcaactctatcgtccgtcgaaactttgtgcagccgaaggatgatgccatcgcaaaagatgtccgccgtacaccgggggaaaaggaacaaccgaaagagggaaccgttttattcgatacgcatggtgcctatctggatgctccccgcaatgtggcaaaagaactgggagtgactttcatcgacatgaacaaaatcacccatgacctggtgcagggacttggaccagtagaatcaaagaaactattcatgtttgtcgaacccaatcaggtgccggctttcccgaaaggtcgtgaagacaatactcacttaaacgtatacggagcacgaacaattgccggactggcagtggatgctatcggcaaggaaattccggaactggcgaaatatatccgtcaattcgattatgtagtggcccaagacggtagcggtgatttctttaccgtgcaggaagctatcaatgctgttcccgattttcgcaaagacgtccgtaccactatcctgattcgtaaaggaacttataaagagaaactcatcatccctgaatccaagattaatatatctttgattggagaagacggtgcgatactgacttatgacggttttgcaaacaagaaaaatgtatttggcgagaacatgggaacttccggttcgtccagctgttacatctatgcccccgatttttatgcggagaatatcacatttgagaactctgctggtcccgtaggacaggcagttgcctgctttgtgtctgccgaccgtgtctattttaagaactgtcgttttctaggtttccaggatacgctttatacatacagcaagcaaagccgccaatattacgaagactgctacatcgaaggaacggtagattttatcttcggttggtctacggctgttttcaaccgttgtcacattcatagcaaacgggatggttatgtcaccgctccctctactgataaaggtaaaaaatatggctatgtattctatgattgcagactgactgcggaaccggaagccacaaaagtgtatctgtcccgtccttggcgtccgtatgcgcaagctgtatttatccgttgcgaactaggtaaacacattctccctgtcggttggaataactggggcaagaaagagaacggaaatacagtcttctatgccgaatatgagagtcggggcgaaggagccaatccgaaagcgcgtgccgctttctcccaacaactgaaaaacctgcaaggatacgagattacgactgtactggcaggcgaagatggatggagtccggtagcggacggaaacaaactgataacagtgaaacgttgacttgacgaatatgtaaagaaatgaattactaagcaaaaaacaatggatatataaaagacaatagatcacttgtcctatagaatggttcgattctgttaaatagccgctaaagattgcataaaagtacaactatttttctatctttacggcacagaacctagttatatgatgaagaaaaccttaatttcagtaattcttttgctagctattgtgttcttgacacatgcgcagcagcactgttttttcacccactattctactgaagatggattgtcccagaatacggtgatgaacatcttgcaagatcacaaagacaacctttggtttgccacttgggatggaatcaaccgtttcaacggttataccttcaaaacatataaggcccgtcagggaaactacatcagtctgaccaataatcgcgtagaccgtatctatgaagaccgttatggttttttgtggctactgacttatgataatcgtgtccatcgtttcgacccgaagacagagactttcgaacaagtacctgctgccggagaggaggggagtgctttcaatgtgcataccattgaggtgatgccgaacggaaccgtctggctgctgacagaaaatgacggagctatccgcatcctgactcatccaaatgagaatcatcgcctgacatgggatatttattccagtaagacggaactgtttccctctttacatgtattcaaagtacatcaggacaaagcaggtaatgactggctgttgacagataacggtctcggcatgatccgccccggaaagaaagaaccggattcctattttacggagacaaaaggaaagtttggcggcataaaccaagccttctatgcagtacaggagcgggataaggacatctgctttgcttcggatcatggacgtatctggtcttatcagaaagatagcggagaatttacgttgatcgaacttcctacaaaaggacagatcacttccattcaccccgttgcaccggacgtttctgtaattactaccgattcggatggtttctttacttacaatctgcggaccaaaacaaatgtgcattactcattcctgacttgtaaggctttacccgcaaaaccaatcctttctgcttatgtagaccgttcttcggaagtgtggttcgagcaggaagaaccgggtgttgtagcccattttaatccctcgaccggagtggtgacccgtgaacagattcttattgaatacagtaatcccgaacgttcccgtccggccttccatatccatgaagatgtaaacgggtatctttgggtacacccttacggaggaggtttctcttacttcgatcctcaaaaaaaacggttggttcctttctataacggactgggtagccgtgactggcgcttctccaataagattcattcggctttctccgacaaacaaggtaatttatggctttgcacccactccaagggattggagaaggtgacttatcggaatgtaccttttgcgatgatgactcccatgccgcatgaacatgaatcattgcataatgaggtacgtgccctgtgcgaagacaaactgggtaatctgtgggttggcttgaaagatggtatgcttcgtatgtatgatgccgataaagcttataaaggatacctgaccgaaagcggcatcgtttctactaccggtactcccatgttgggaactgtttattttgttattcaggattcgaaaggaatcatctggattgcaacaaaaggagacggacttgtccgtgccgagccgacttcttccaacggaatgtcttataaactgacccgttatcttcatcgtgaagaggatatgtacagtttgagcgataataatgtgtattgtatctatgaagatcattatggtcgtatttgggtagctacttttgccggaggtatcaattatatcacgcagaatgaagcaggaaagacattgtttatcaatcaccggaataatctgaaagggtatccgattgatccttgctacaaagcgcgtttcattacttccgataataatggacgcctgtgggtaggtacaactacgggagctgttgcttttgatgagaactttaagaaaccggaggatgtgcagttttatcatttctcccgtatgccgaacgatacgcaaagtctgagtaataatgatgtccattggattatttccactaagaaaaaggaactgtatctggctactttcggtgggggactcaacaaactgatatctatcagtaaggacggccacggagagttcaaatcatattccgtactggacggtcttccttccgacgtcttgctttctgcccgcgaagatagtaaggagaatttatggattagtacggagaatggaatttgtaaatttatcccgtctgaagaacgttttgaaagttacgacgaacgtagtattactttcccagtgcgctttagtgaagcggcttccacattgacggctaaaggaagtatgcttttcggtgccagtgggggagtctttatatttaatcccgactctattcgtaagagtagctatatcccacctatcgtattctccaaactgatggtgactaatgaggatattacgcccggagataactccttgttgaaggtggatattgacgataccgacccattggtgctctcacacaaagagaatattttctccgttcacttcgctgcactcgattatactaatccgcagaatatacagtatgcttatattctcgacggatttgagaaacagtggacttttgccgacaagcagcgtagtgtgacttatacgaatcttccgaaaggagagtatgtgctccgtgttcgttcaacgaatagtgatggtgtgtgggtggataatgaacgtatactgaacattgttattctgccttctttctgggagacgccggtagcttatgtgctttatgttctttttattctgattattattctcgtagccgtttatatcctgtttactatttatcggttgaagcatgaagtttcggtcgaacagcagatttcagatataaaactgcgtttctttactaacatatcgcatgagttgcgtactccgcttacgttgatagccggtccggtggagcaggtcttgaagaatgataaattgccggctgatgctcgcgaacagttagtggtggttgaacggaacaccaatcggatgcttcgtcttgtcaatcagattctggacttccgcaagattcagaataagaagatgaagatgcaggtgcagcgggtggatattgtacctttcgtccgtaaggtgatggaaaattttgaagctgtggccgaggaacatcggattgatttcctgttccagaccgaaaaggaacatctttatctttgggtggatgccgataagctggaaaagattgtattcaatttgctttccaatgcatttaaatatacgccgaatggcaagatgattacgatgtttatccgggaagatgaaaagatggtttctatcggtgtgcaagatcagggtatcggtatcgcggaaaacaaaaagaagtcactgtttgtccgttttgagaatctggtagataagaatcttttcaatcaggctagtacgggtatcggactttcattggtgaaagagttggtggaaatgcataaagcgactatttccgttgatagtcatttgggagaagggagttgcttcaaagtcgatttcctcaagggaaaagaacattacgataaggaagccgagtttattctggaagatgcggatgctccggcaagaatgggacaggtagtggatattgccaattcttccattcagtctgaaacgttggtaagcgatgattcggagaagattgatgatgtgtatggggaagaatttgcgaaagaagagaactccaaagaattgatgctgttagtcgaagataatcaggagttacgtgaattcttgcgcagtatattttctccgatgtaccgggtggtggaagctgctgacggtaaggagggggcaagcaaggctttgaagtacctgccggatattatcatcagtgacgtgatgatgcctgaaaaagacggtatcgaaatgacgcgtgaactgcgtgcggatatgacgaccagccatatacctatcattttgcttactgccaaaactacgattgaaagcaaactggagggattggaatatggtgcggatgattatataacgaagcctttcagtgctacctatctgcaagcacgtgtggaaaatctgttgatgcagcgtaagaaactgcaaagtttctaccgggatagtctgatgcatatcaatatttctaccggtcaggaggaagtgcctgtggctacggatatgccgtctgctgaagaagatgtgtccgaaactccacctacaactctcgaaatgtctcccaacgaccgtaagtttatggataaattggttgaattgatggagcagaacatggataatggagaactggtggtagatgatttggttcgggaactggctgtcagccgttctgtcttcttcaagaagctgaaaacacttaccggattggctccgattgaatttatcaaagaaatgcgtatcaagcgggctacacaattaatagaaaccggagaatttaatatgacccagatttcgtatatggtcggcattaatgatccgcgttatttcagtaaatgctttaaagcacaggttggaatgacgcctacagagtatcgggatagagtggggagataataataggaaaggaaagaaatagaaagggggatgttcaaagctccccttttatcgaaatcaccctcactacaactatctgtggcgagggtgattttttgtttatgagagttccgatacatttaccctcatcttggttatccgaaattattttttagggtatagatgattcacaaggctgttcatatatatttccaggtttgtatattccgggcttaatgtatatttggctccgtctgaaggatcattgggattaaggttgtgtttcttttcccattcatcgggaataccatcaccatctgtatcaacaagtgctgtttctgatttatattccggccatcctcctacatcagacggttggtcaatcattccattcgtgcttccgtgagaaccttcgtaagtataagtgcctttgagagtttcatctacgatgcgttggtctatggcgtcacggcgatatgaagcaccggcaaactcgagaacatctttgtaggctttcttggcaggttgcaaagaagtatgttcggctatgtcaaatgcttttttagacagtacttccttttctgtggcaaagtcttttttgataaccagtccgtaagagttatccatattcactttataaagagcctctttctgcttgtcagtcagtttgggacaggtaggatccatatagttacctttgaaatagaatacaccatgaacacctgctttattgttgtttttgccatcatcggcatacgctgtaaacaagcgtttgaaagaaccttttgtcgcactgaaaggtcccggtttatagtagttattaataaagttgtaggaacctccttcaccagcataagcaccgtcactgccataattataaatcacattattgaataattccactttttcatcttccggacgacccgtataacggcttccgcaaagacggggtgtgcggttagtgtgatgggcgagtaagttatggtgaaaagtagcaggctgtccaccccagatacctccataaccatgcgctcccttttcgtggatagaattggcgagactttcactgatgatgcaccattgaagagtgaaattacggttatcatagaatgtggcacattcgtccgtacaccagctcatggagcagtggtctatgataatgttttggtgcgcttttgtaccattcattgcgtcgtcacctttttgtttgatgtcgactcccatacgggaacggatgaaacggatgattacattgtctgcctgaatagagaatgtatagtttttcaggcaaatgccatcacccggagctgtctgtcctgcaatggtcacatcaccattgctgagttttaatgctttttgtaattcaataattccgctaaccgcaaagacaatggtgcggggacctttcttgctgatagcccagcgaagtgttccttccgaaccgtcgtctgccagggaagtaacagtgtatacagcacctccggcaccaccggtggtatattttcctgctccgtcggcaccggggaaggcgagaactttggaacgatccggggtaggatagtcctttgatgttttttcaaccgaaatggcaggttgcatggcttgtcccactagaggaaaagccaatatcaaactacagattgctaatatattctttttcattactaatttatcatttgggttcgaatttactaaatttattctataacactgccacctgtcgcaccatttaccatgatttcgtgcaccagactattgagatacatttccagattagtgtacttcccgtttttgtcaatagtcgtttcttttccatcagcagatttcttgggattcaaaccatattcttcttcccagtagtcgggaataccgtcaccgtccgtatctttcacgtttgcattggttacagatttcagaacatcgtagggatcatttactcctaaggctgtgcagacatctttcgggtcgttgatatatccacttttgttttgtgagtagccggaaagatctttccatttgctggcatctcccgtgcaacttgcttttctgtttttaacgtcgctgattatcaactcgtcgactttatcacgatagttgctggctcctgcatagctcatcacacgttcataagcctcatccggcgtatgagttcttacatttcctgccttaactaccggtgaatttgactttatctgggtatgttggttccaaagctccgtagttgcacagtttttttcatccatttgttcaaatacgccttttgtccagttatcattgctaacagtcgtattgcctaccactttatttccgtcgatataaaacttcccccaagtttgaagccattttttgtaagcttcgccggagtaattttccggatatacatccggcttggcgatacggtaagcacggtctgctttaccgctttcatcggttccggggcctggcttgtagtagttgttaacgatattcacgtgttgcgcttcaccaccgtagcagccttcgcctccccaattgtagtaaacattgttgcgcatatccactcgctctccatcgttgttgttcagtgctaatgtagtatatcggggaccaaggcgtggaacacggctttcgcaatgggctatcaggttatggtggtaagaggcatagtttcctccccagttaccgccatatccgtgagaagcgaatttacctgtggcagcattgatctttacatcagtcacacgtaaggcttgataagctaaacaccattgtacggtagaattttgcataccatagacagaaagacattcatcgcttccccagcttactgaacaatgatcgatgattacattttgtttgtcacaacctcctaatccgtcgcagtctacgttagagtttccggggcgaaaacggatgaaacgaatgatgatattgctggaattaatcgtaaatggataattggcgatacagataccgcccggtgatgtttgtccggcaatggtcagatcatctttctgggtttttaattccgatttcaaatagatggtacccgacacatcaaatacaatcgttttaggaccgtcttgtttcatagcccagcgcagacttccgctgatacttccactggcgtcgtcttcaaggctagtcacatgataaacttttcccccacgtcctccggtggtattgcgaccgtgaccttcggcgtatgggaaagcaagaagttctccataatccagttgcttgacatcagaagatgttccacctggattatttgttcctccacctgtatcatctacaggatcgtcggaagagcatgaggtacataatcctgcgatgctgaatgcaatagctacataaaatagagatattttctgcttcattatcttttaactgtttggggatatagacgatttatttgttgggatacaacgtttctaccagactgttgaggtaaacctccagattggtatacgttttacttagagtatatttggaaccgtcggccttacttttggggttcaaaccgttggcagtttcccattcatcagggatgccgtcgccgtcggtgtctttcggaccggtttcctttttatattccggccagccacctacatcgctggctttatcaataagtcccttttcactgccattactgccgtctgtcgtataatctccgttgcgaacgttggctatgatgcgtttatcgacatcatcatattttaaggaagcaccggcatactttaatactgattcataagcttcttttgccgattgagtgaattcggatgcatcttcggaaatagtaaattcgttacttgactgaagtgctttttctcctccatcgggtaaaggaacggcttctgttgcattggggtgtaacccttgccagttgtcattgtttacagaagtaagcagagattgatattcggctttcaattcaggacatgtgccatcaaaatagtttcctttcagataaaaagtaccccatatacctttggtgtttttatttgtaccgtcatcaccgttaggttggaagatacggtttacaatatttttcttggtattggtaactggtccgggcttgtagtagttgttcacgaaattatagcttcctccttctcctgcatagccaccattggtcggtccccagttatagaaaacattatttcgtaaatcgactttttcattttccggtttccctgtatagcggctaccgcataaacgtggtgtacggctgctgtggtgggctaataaattgtggtggaatgtagcgggtgatcctccccatattcctccataaccgtgattacctttggtgtgtaccgaacgattcaaactttcgctgatgatacaccattgcatggtaaagttagtgttatcgtagaaagaagcacattcatcagtgctccaactcatcgaacaatggtcaatgataatatttttatgttgctttccccacagtgcatcaccactgtcggcttctgcttctgttgtaaagttgtccgatcccatgcggaaacgcatgaaacggatgattacgttgtctgcctgtacggatacgggatgtcctttcaggcaaataccgttacccggtgcactctggccggcaatcgttacatctccgttggttatcttcaaggggcttttcagttctatcaatccgcttaccgcaaatacgatcgtgcgctttcccgtgcgatttaatgcgtagcgtagtgtcccttgtgttgtgttatcgttgtcttcaagcgaagttactgtatacacttctccgcctgctccgccggtagtataacgacctgcaccgtaagcacccggaaaggcataacgcgtttcggcaggtgtctcttcttcaccaccttcgttctcattaccaccgttaccggtattctgtcccggtgtttcatcagtgatacttgggtcttcgctgctgcaagcaaccgataggttgattacacagaagcacaataatcccattttaatagatttgagcatacaaattatcttttaaaaaaatagagttctttgtctcatacattatatttgctgatgatgtgacaaagaactctttattaaatcttattggttttattcgcttactgtaccgtactggcttacagttttcactgtataaatattgctttcgtcagtgttggtcagtgtaacggtagtgtctgtagtttgccctgcatagttgccattcataaagatgaggtaaccggcagcaccggatactgcatcccatgtcagagtgtttcccgacagattgacattggtaggtgctgcaaggggagtttccatatactctttcgggttccagctgtcaatagttattatattctcatatgtatatttagcagcttcggatgctgttagcactgaactagtgaaggaaacgtttccggaggtgattgttttactttccgcaatcatatttccattcttgtcgatagtgttatattcagcatatagtgtaggtacttgtccaccatatccccagtgtgaatctataatatccattttcaacttggtgttgatccagacagttttcgtggttgtggcttgggaacgtccgaatgagaattttgtatcatcaccgtttaccgtacaatcttttataacatatccgtatttatcgctttcactggtacgcgaagcagttataacgctaccaccgtcattgcctgtattatagaatgtactgttttcgataagtacatcgccacttccccagatataatctgtatgaccttcaatccatgagttataaacgtatgcacgatgaggggttgtattgttccaataacgggtccaccatgtatcctgataggagacaagcaaacaattattcaaagcaaagcggtcttcacggtttatcaaggcttctgcctgtccgtttttacctaaaccaccagtgtgacgatttgagaatgcaccataaagattgatgattgaaatgttttcagcataaaaatctgtggcttcaatcaacactactgtgttttgctcttcactatatccggctttgcgggctggtgagttttcgttgaaaatagaataaggccatgaggtagcattacttgaatcatctacacggtttactgcaaactggattttaacaccatcgcggctctcaccgattaaatgaacaaatggtttattcttattgatccggacacattcattataagttccgttggctatgaagattttataaggactggtcggtggagtagtgatggcgttgattgctgcctggagagtagtgtaatcgccattcccttttgaatcaacaattgcatcgaatacttttccaccacccgaaatttcagatttggcagtaaagcttaaaaagaagtcttcgtcgtaagctcttccctgcatatccgttaatgctccggcaggaacttcgaaagtacattctttgttttccataccagagaaggtataacgtactttttcgtagttgatggatacacgcactactcctccgttgaaatagatttctgtgtctggagcctgacgcatagctttgctgaaagtcagttctacatatccgctcggacctactacatcaccatcattgatattctgtgaaatcagaacagggatgcttgtatcttctgcatcatcgttgtcattacaggaagcacctgtaagaatcaacaagagcagaagtaagtatttacttattgtattgattgaatttgtattcataatatctgttgctttttagagaagattctccgtcaagtaaatgcaaattccagacttgacggaaaaccttgtagttttatttagttatttgttccaacgttggtcaccgatgactttgtattcttcagaaacattgttgccataagtcaatgtgaattcggaattagaatcagtgcatgagaataattcagatgaacttaaagtcatagtgtcatatgttgtagaactagttgtattagtgaatttgaagtcactagtagcataaactttctgccaactaacatttgacggtgcaactgttgccgaattaaagactttataattagtgttacttgcagcgaacaaagtatttgaaacattaaatgtacatgttgctccagtaatatctctcattaattgctcaccagatgttgttaagccatagaacgtacaattttcaatattagtagtgacattctgttgagtgtttgctgttcttactattgatgaagcggctccaatgaagtttgcaatggtagaattggttagatttaatttgagagatgcgagagaacctgcaccactacttcctgttatatcgcttgcatgtagaatgccataatgtccaccttgtaatcctttgataatacaatcgtcaatttctattgttgtatttgcattacttgttgttttacgtacacgaataacaccacggaaatctcttatcatacaagatgagataactaacttttctacagaaccagaattagtcttaccttgattatccaaataaatgacaaaattgccacctttatttgtagaataaatatctagattatagaattcaatctttttacattgtccagagaaatcaatgttattaatttctacacttggttttgtttcgcttccccagaatacaatttcctcaatgtcagcaggaatactgttattaggcagaattattgatgcatcgttgcttatattaatcagtacctttccactcaaagtagaccaatctacattttcccattctatttcagtataacccgtcggtttacctttcttagttgtaaaggtgatacgggaacatatagagccgtttgcgaaagcataagccgtatattccgtactggaagccaaacctgtgattgtcaccttatgtgcagcaatatctgctggtgataattgggttcctgattcaggtactccttcggtagaaagaacacaagcatattcatctacatccaccgtttcttcccatgagaatacagctgaatttgctgttatatcactgatggtagattcgatttccaaaccaggaatggtaacagtctgtgaaccacgcggattattttcattataaatagtaattgtgtattcagtgaacgacttcaaattttcaacccatgcttcacctgcggcagcttctgttgacgaaataacacgtgaagttgcttctgtggcacctgtttccatgatttcgaaatgatcgactgctaatccggcttcccatgacatgcgtacttttccttgaccttcaggtaagtcttcagtagttgggatattcaggatagcttcttccttaactgaagcaaaagtctttttataatttacccagcgagattctttctctccggaaatagacttgatacgcatataataagtcgtatttacagccagattatccattgtgtaaggtgactgcttgatccggttggcaggatcatttccataaacgatatttccattttcttctgatcccattggagtttcgtcagtcatctcgttaggactaatctcgataatgtaatagtcggtattagatgttgagctccaagttactaccgctctggctactttactgtctgtttctacactgattccgttttcatcagttccgaaaggacggctgtaggaagagtcaatatcccaatcacttttctctgtacacgaagatacagccaaagaggccaggagcatgaaagctcccattcccaatatattttttatattcttcatcattttacgattttaagattaatccgaataaccataagagttatgtaatttaccgtttgaggtagagatggttgtagaagctatcggcaataaataacgattcttcacagccttgttcaatccgccagaaatactaggcaagtttactttcagattcttttgctccttgtcactggtttcagctccgaagaagctcttgttttcatattctccacctactttagctccaaatacgagagaagtcatatcgatatacatcggattgtccgtgcgatatttatagttcacatactgtggatatgtaccattatacactgcatttgtatattcgtttttgaactcgtctattttttcgctcaacaggttccaacggattaggtcgaacttacgaacaccttctcctgccagttcccatgcattttcgtcaacaattgcatcgaagaagtcttttcccattagagcagtccatgcagcatcacgtttggttgcatcggtgaaagcacggtcgtgtacttctttcagggctgctgtggctgttaatgtacaaccttcggctgttgcacccttaccataaagttcgttcacaacttcggcatacatcagcaatacttgcggataacgcattttcactacgttgataccggaacaaactttctgatcgctggccaatacagctgcgtaccattcagagttttccatcatcttacgataatcccattttccacaataaagaccgaaaggagcatttcctaacatatattctttaaatactttggtgtttttgtctgtagaaagttgtgaaatagcacaagtcagatcgcggcggatatctccttcgccaaatgacagataataaggagcagtcagtttcaacttaccggatgagttacctttcggaccgaatagggaactggcaccgtttatacgatatccgatagtatatcccagctcaccacttttgtttagtcccattggaatctcgaacaggttttcttgataagtctgatctagttgtccgatatttattaaacgccagtattcttctacagaaggattcagtttatgttttcctgaactgacaacagctgccagatgtttttcggccaattcgaatagttctctacgtttggtatcgctgcaacgttgagtaggataagtagcgtcactgttatctccggtgatatatccgtctttagcttgttcgcggatagcatatccggcacgtgtcattgcaatgttagccaagagagcgtgagcatagcctttgcttacatgttcggttgtataaccgtcttcaccagcccaaggtaaatatccgatagcttcctcgagttcaattatcaattcatccatgatatcgtcacgatctgcctttccaatgtaaacattagacaggtcgctgttggaagattctgttttgaaaggaatatcaccgaacaagcggatcagatcgaaataaatcatcgcacgcaatgtcatcgcttctgcacggaatctcatcatgctggtacgggttgctcctgcttgttgtatcagttggctattgtttataccatctactaccagattcgcattctcgattactccgtacatggcatcccatactttggaaagttgtgaccatcccggattagcgttgtagttcatattaccacgttcgctggacgtgttgcttgcatccgtacccaaaccgtcaatcagttcacagtcggtattggttccggcaatgataggtaggaagttagaataagtctggtcttgcgtcaggctgccgtaaactttattaagtgccaattctgtataataggcattattaaaagttgattcattatccaattcagacggtgaggtctgattcaggaagtccgaacaggaagacagggcaattaaccccagccccaggaataatgtcttatatattttcatacgatcaatctgtttaatgttttaattagaatgtaacgttaataccacccacaaatgtgcggctcttaggataagcggcgtaatctatacccggagtcatcgcatttttcttactgcttgtatcgacttcagggtctgctccgctgtagttagtccaacagaacaggttatatcctgtcagatagattctcacattctgcataaacgctctccttacaattgttttcggaagagagtatccgatagtaatgttattcaaacgcaggaatgaggctttttctactgcataatcagtcagctgcatggtagtagcgctggccggattgtacatattggcgttagcgtttatttcattcagacgtaatcctgctgttgtcatgtctccataggtattaaggacatctgtagagctggacgacaggttcaaaccagtttccggatcaatccatgtgtaacggttagacagtctgaaatcattgtttaagttataaccggttcttgaacctgaacggaaagaagctgccagttttgttccattgacaattacatttccgagagagtagttgaagaatacattgaagtcgaaattacctacgcgaccatcgaatccaaaaccaccggttgtaggagcgatagtgttacccaaacgttgtttgagagggttaccatctttatcacattccagtttcaaaccacccggatagtatttaccaccggtgatagtaggactgttatcttgcattccgtcttttaatccccattcgctacctgcccaaaccagttcgccggtagggttggtgacaggatcatatacagtataataaccgtttgtcttatatccccaaacttcacccaaacgtccgcctttctctacgcggaagtcttcgtatttggccattgtactacctgaccagttactactttgccagggagagtctgtattcagtttatcaatgcggttgcggttgtaagcaatgttggcattgaagttcaaagagaaattctttttatcaaataaaacagcactaacagacaattctacacctttattggatgtctgtccgaagttcttgtactgatagttatatccggagagagaaggaatttcagtacgcatcaataagtctctggttgtattccagtaaaagtcgatagcaccggagatacgattgttccagaatccatagtcaataccgatgttacgggtaactgttgtttcccacttcaaatcggggttgtataagttcgttccatgttccaacatggtagtgctttctccgttgaagaaaggattgcgtgcatcattacctcccaaagagtaagtggtggaaagcaaaccggaattgatacggttgttaccggcagtaccgaagcttaaacgtagtttcaaagctgacagccagtcttgagtgttactcatgaaagcctcgtcagagatacgccatgccaaagctgctgacgggaaaacaccccaacgatttccggaaccgaacttgctcgaaccgtctgcacgtactgtaacagcaagcaagtatttatccatcatagtatagttcacacgaccaaagaatgataatatgttttcttttgcagcaatggtagattggttggctaaagctttgcccgaacccatatttgctttcatatcatcgaaattcatagtaacagggaaagctacagatacattttctattgatttcctttggctgctgcttacttcatgtccgatcaatacattgagtttatcacgacctttgaacagttttttgttatcataggtcaatgtgttggcattacgccagctcatcgtcttttctctcaacaggtaggcttgtggctgaccgttatatccatatttagaattagatactgcatctactccccaatactgttctgtatcgtcaaacttccatccatatccgaattcggaacggaatgtccagttcttgaatggtttccagtttaaacctacattgtagttctggttgaaagtattgcgggttttatccgttgcaagcagacgttccaatggagatttctgttgtgccgaactgttttcttcgtcgtcatcactgtatttaagtgaatcaaccggacggaatacggtagcattagccacagttgaattggcagcattggattcattggtatcagcaccaccacctaaaccgtcaatggtagagtaacttaaccgggcgttaaagtccagtgtcatccatttattcagttctgatttaatttttgcatttacattgtcttttttgaagccggaattaagcatgatacttttttcttcattatgggcatagctgacactataagtcatttgcttggttccgccacttacattaatgttgtattgttgctggtttccagtacgtccgaacatctcgtcttggtaatcggtaccatcaatagaacgccagatatccatatcggcaaagtttccataatccagagaaccgatttcacgctgataagcaacgaaatcgtaaggactcaagacttcagtcagtttggttacctgtttaaaaccgaaagaagcaccgaagtctacttgcgttttaccttcttttccgctcttggtagtaatgatgattacaccatttgcaccacgggcaccataaatggctgtggaagaagcatctttcaatacgtcgatgctttgaatttccgagggagcgatatcactaatgcttgaaacagggaaaccgtctacaatatataaaggagagttatcctgtgatagtgaaccaccaccgcgaacacggatctttatatctgcatcgggagaaccttcagtagtagtaacactaactccggcaagtttaccggtaagggcttcagatgcacttgctactggtatagcagctaagtctttggcactaacagaggctacagaaccggttaaatctcttttattgaccgtaccgtaaccaattactacgacttcgtccaaagctttcgagtcgtcgaccatttgtacattaattgtttttctaccttgaacggctacttcttgagttttcatacctatgtatgaaataaccaatgtttttttgccatcaactttaatagaaaaattaccatctaaatctgtaatcgtaccattggtagtattacctttttctacaacagaggctccaataacaggctctccgctggtgtctttcacgttaccttttacggtaatcgtttgcgcagatacgctaagcgatattgctgaaaatagtattagcaataaggagcgcatgtttttcactttgttagacattctttgcatgtttattaattaatggttgttgtttgatatttcataaaaatcccgatgagagttcattcatcgctacaaaagtatgagaatgaagatatagtgatgtgcaatatttgtttttcacctcgtattttttgttttttagtttgttgcgaggtgtagttattagctttgaagggtgttatttgtgttctaaaggccggcaaatatacgaatcagagatttataaattgattttttcaccggtttttatccggcattcatcggaatttataccgtaaatcaactgaaaagcctgtggaagcatagggaaatgatgtatctttgaaccattaatcaattaataatagaaacaatggaagagaaacaaaattttccccgtgctacaggcttttccggtaaaatactgatagctttgctttttatcctttccgggattctactgtttgcccgtaatatgggatggataacttcagaagtatttgatttgatcgtatcctggcattcactccttatattattaggtatatatgcaatgattcgccgccatttcatcggtggaatcatcctttttctggcgggtgtttattttctgataggaggactttcctggttaccggaaaattcacaggcaatggtgtggcccctcgctctgataatagcaggtgttttatttatcttcaaacccggcagaaataagagggcgcaatgggctcgtcagcatacaatggaacatcgtcggcaatggatgaagatgcatcagggtagacccggcatgaactttgagagtgagcaacaacaatcggaatcagtagatggctttttgcgttcggagaatgtctggggagctgcacgtcacgtagtacttgatgagttgtttaaaggagccatgattcgtacctctttcggggggacgactattgatcttcgccatacccatattgcaccgggagaaacctatattgatttggattgcagttggggaggagttgagatttatgtcccgtcggattggacagtcgtcttcaaatgcaatgctttctttggaggatgtgatgacaaacgctggcaaaatgggaatgtaaacaaggagaatatattggtcattcgtggaacgctttctttcggaggcttggaagttaaagactagcgtatgaaaccacatccgataatagattatccattccgctggattccgatgctggtgctggcgtttattctggttgcgacacaggtggctttagtctgtggatataccggaaacgactatcttcctgctctggtagatggagtggcaacaattggttggctggcagccatagcctatttggcctggtttgtggtcggtcttgtttcgttgttccagacggatataatcatgataatcgttggaagcctattatggctggcgggtagttttatgatctgtgatatcatggtgaggattgtaggcatatcctatattccttttgtgcagaccatacctttccggttattgttcgggctgccaaccttgattgccattactttatggtatcgcctgatcgtaactaaagaagaagtacagaatcaggaactggataaagaattggctgcacatcagctaactgtgaccgaacaacaaggagaaccacagacagaattaatagatcgcattacggtgaaagacggttcccgcattcatctggtaaagacagacgaactgatctacatacaagcctgtggagattatgtaatgttgataacccctaccggagaatatctgaaagaacaaactatgaaatattttgagacccatctgtctcctgatacttttgtgcgtgtgcatcgttctacgattgtcaacgtaacacaaatttcgcgggtcgagcttttcggaaaagaaacttatcagttgttattgaagactggcgtgaaacttaaagtaagtctttccggttaccggttattaaaagagcggctggggatctaaaatttgttcaatcttatcataaaaactgatttttcccctatatcggtcaaaaaatgaatgtcagaatgaaaagcttccactacttttgtttccatcatctaataatgtgaataaggaaatgaaaagaaaattagtttatgtttgtctgctggcaatggttgcgggaggaatgatgtccttttcctatgacatacccgaaaaacaggagacaggcggccgggaagatcgagtgatctcttttcccggagctgaaggacacggtagatacacgacaggcggccgtggtggtaaagtgtatcatgtgacttctttggaagacgatggttcgcaggggactttacgttgggctttgaaacaaaatggacctaaaacgattgtctttgatgtggcaggtacgattcatctgaaatcggaattacgaacagggaaagatcatctcaccattgcaggacagacttctcccggaggaatctgtctggctgattatggcttttctattaattctaataatgtaattatccgttttcttcgtttccgccccggagaagccagtgggaaagaacccgatgggttgggcggctgtgataagaaagatattatggtagaccattgctctgtcagttggagtgtagatgaatgtctttccgtttatggtatggaaaactctacggtacaatggtgtattggctctgaagcattaagaaaagcgactcatgtaaaaggggcacatggatatggaggcaattggggaggacataaagcttcttatcaccataacctgatcgctcactgtgagagtcgcgtgcctcgtctgggccctcgtccttctacattagctcttggcgaatgtgttgatatccggaataatgttttctacaactgggctggaaacggttgctatggcggggaagatcagcatgtcaatatcgtcaataactattataaaccgggaccggcaacaaaacaggcttccaaacaggtgcaatatcgtattgccaaagtcggagtttatccgcaagcttatgtttacgttgatggagaacccaaaaagaacttggcttttcaaccttacctgcagaaatggggaactttctatattgatggaaataagatagaaggtaacaacaaagttactgccgataactggacggacggagtctatgcccagttgaagaatgatgaaaaagtagatttcctctggacagaagatgccaaagaatctatccgtctgaaagaacctcttgattttggagtaatcactacttattcggctgacaaggcttatgaacaggtgatgaactatgcaggttgctgtaattatcgtgatgaagtagacaaacgtatcatttccgacacccggaaaggaacggcaactttcaccggagaaggaaataaacccggatttatcaatagccccaaagacacaggcgattctccctggccggaattatcaatagcaggtctttcggcaccggtagattcggacggtgatggcatacctgatgagtgggaaataaaaaacggacttgatccgaataatcccgtagatggaaatacaaaaacgaaagatccgaatggacaatatacgaatcttgaggtatatttgaatagtttggtgcaacatatagtcgatgcacagaacaaataggtaatcagcaattccccgttcaatgcggagaatttagatgatatgcccttcaggtgttttatgataacatttgaagggcatatcttttttgtgcatggctataccagaggggcacttttttaccccagtccgttttttactccttttctactaaatcttactctatcttctcttgcttaatcctcaattttgcactggtgaaagaacaaaaaaatcactctagcgaaaaacatcattaatgtacaatgaaaatctaaacaaatgagaaacatgaagccagcacttataatagccaatcctccttaggcttggatccgccttttaaagaaaaagggcatagaatttttattcttttaataattgtatatctttaaattatatataaactaatatttatgaaacatctagcaagtttatttcttctgtcatttctgctttgctgttcttgttcacagcaaatggatgatgaatggaaaccgaatgaacaacttcccaatgtgcccgaaacccaaccggttggcgtttctttcagtagggctagtcttgaaacttttgctgaacatggaattacagaggtcggtgtttatgtctacctgcaagattccatggtatatggaaaaaatctccctttaaataatggagatttaaaagtcgaccttcctttaggagaaaatctgcaaaccttcatcgtggcaaatgccgatcatctggtggatacagatagtctttccaaagttgtagtttatcaggatgctcatattcaaaagccggtttatatttcggatgtcgtaggctttacttcagataactcggtcagttcgctcaacgtagaattgaaacgtttagtcgggcaagcagtgttccagccgaaagagacggaggaggaattgagtgctatcactcgttttgaccagttgaatgtcacttttacaaatgtggcaataggctataaagtaaagagtaaagaatgtattacagaaaatgtgaccatctccactaatctttctaccggctttggagcttcggtttattcatttcccacagtgaatggagattccagaacatctatagatgtggtatatctgaaaggaggcgaggaggtgaatcgcatcatcagccctcttgataccggtataggctttgagtcttccaagcgttctaccgtacatatgaaaattacggatgagaattacttggacgagccgtggctttcggtacgcacagtcatgtataagagtacatccactcaaccgtttacaatagaagtttcagaattttaaaacaggagttatatgagaaatatattctattcactgacgggaataatgctcctgttgggaataacagcttgttcggaagaagaacgatatgccacttcggtagtaaaagagatacaactgtttctggatgacgaaccgtgggcggtgaacacaggtgcctctaacaaacccctgtttatctatacagccgatggtgagtatgtagccaactattcgtcgctttatcgctttcagttgcccaatgggagttataacattatttctaccacacaatccgattctattcccagtccgaagaatctgaatgatattgtgatacatcaggatccgacggctaaaacaaaatatgccatttcggcaccggtggcgtataaatccccgttcgacgaaccgcttagtgtgcgtatgtacaatcgtacaggtgtgcttcgtctgaagtctaccgatcgtaaatcggataaaagctactcgaaattacgcgcagtcgtttcttcaccaatatcaggatataaactatcggatgctacttttgtaaaagctccgacagatgtgcaacgcgagaaagagacaacaaccggtggagtgaactacaccgatgactttgtattgtttcaaacgcaaagcgaaggcggaacagtatctgtgcgtatcgactatctggataagaataatacggtagtccaatctaaagctatcgatggcacattccccatcttgcctgatgatacggtacaagtggcgtttgcactgaacaacgtagatgaaccgatcatacaagattacactgtaacaattgcttcggaaggatggaacgaagaagatatcaatccggaagctccgatgagaattcctgacggatacagatatgtaagtccggaagagaaccttgaatcaatctgtaaatcaatgctggcggatgcttctgtaaatgaggtgaaacttttcctgaaagcaggtgctacctataaattaggtacacagaccgaaataccgaaagctctctacatcatgggacaggcaccgggtgatggtgaagaattggcatttatggaaatgggcaacatgagtatcaactgtcctgatgccattattgaagccttccacttcgagaatctgaaaataaaggtgacaacttccgatttctttaagtttaaaaaccaagctttccatgtatctactatctcttggaagaactgtgaaatcagcgatttggtacgtacaatgtggtatcaggaagtagatgctgcacagaaacagattgccgatcatattgtgattgagaattgtcgtttcttaggtttgaattccggtggaagtggcctgttcggtctttctaccaagcaggacgcgccggtacacaactttgtgttcaagaactctacgttccatgccaacaatctgacaagagctttgataaccggtttgggcagtatgacaggcgaattgaatgtgacaatagagaattgtacatttgtgagtatggctcctgctgcaatgaccttcttcgacttaaatccgaagaatacctcttcattccacttagttgtccgtaataatctctttagtggtgtttgtgaagtcggacagggaacttggttcactacaagaaacgtcacaagcaagactttcgagaataactatcgcaccaatggctttgtagtggctaactggggagttgatactgctgaaataccggtagaaacagctctccctatggaaacactcttcaaagatgtggctggtagagatttcactattactgataaaaactccgaagtatatacaaatggaattggtgatccgcattggattaaataatcaatagagtattaacaatataaagatataaaacatgagatattttctattcatattattggtaggattgttgagcgcatgtagttcggacgacgaatctaatgcgggtgcaacagctgccaaactggaagtgtcgaagaatgaggtgaagttgagtaacgtagacggttcgtttacaatcaacgtaacggctacctctacatggactgccgaagtgacctcgacaggcgactggttgactatatcaaaaagctccggagaggggaatggtgatctccgtttgttttttaccgagaatacagacggtcccaagcgcaccggaacagtaaaagtatcaatgtcgggtgcaggctcgacattggaacaagagattagcgtagagcaactgggggccgatcccgatattttgtttgattattcatcagaccctttgtcattccggggaggtacattcacctgcaaagtagtggcaaatgtggaatgggaactggagatagcagcagagtacgactggatcaagttgaaggaagcaactcccagaacccgcagttttgtgacggatgaagtaacatttgccgtagatgcaaatgcaaacaaaaccagaacagccgtcctgatattcaaatccgtaggagattatacattgcagcgtgtcctgaaagtgacacaagacggtgtaagcggtgaggtgacgatagaacaggatgagtatatcattccttataaatgtcctaaactggttatctcggctccgcaaggagaaaacccggtagattacgatgctgtaatatccgagagttggattacgcaggataagaaaaactctactgccaatgaagtcgtattgaatatcgaaaataatgaaacagtctttccacgtacagcaacggtagagatgttggataaagtaattaccatcttccaatatggtaaacccgatacaagcatcggtgacgatcattctacttctatactcgctttcccgggtgccgaaggtggcggtcgttttactaccggtggtcgtggcggcgaaatctatcgtgtgaccacgctggcagattataacaaaaacgaaacccctattgagggcagtttacgctatggaattgagaaatccaaccaaccacgcaccattatttttgatgtatccggtatcatcgaactgaaaagagggctgtatctgaatgaatatcctaatttgagtatcattggtcagaccgcaccgggcgacggtatcacattgaagaattacaacttcacctttaacctgtcgaaagatccagctattggtgcaggtggcagtctgaatgctattgttcgtttcttgcgttgccgtccgggcgatcagtttgccgattatggagaagatgcgattggcggacgctatttcaaagatgccattatcgaccatattacagccggatggagtgtggatgaaacactgactttctatggcgtacagaacttcacggcacaatggtgtatcgcttctgaaagtatgaacctgtctaaccatgccaagggtgctcatggttatggtgctatgtttagtggagataatgcttctttccaccacatactgttagcacaccacggtagccgctgcccgcgtatctccgatttgtctgctcccggtacacaagaatcttatgactttaccggatatttcgatgtgaggaataatgtctactacaactggagtggaagaggacaaggcagttatggcggaaagtatgctgctttcaacctgaccaactgctattataaaccggggccagctaccggaacaaacaaccgttcttaccgtatcctgtcaagtgatcctactgccagagcttatatcaatggcaattatgtgttaggtaacacaggtgtcacggctgataactggacagagggtgtttggggacaattcgattcttcactgggtacggttcctgaagcagaaaagcaagctatgaagatggcagattaccaacctttcagcaaactgaccagtcacacggctgaacaagcttacgataaagtattggaatatgccggagcttctttgcgtagagatgtgatagatcagcgtatcgttcgtgaagtaaagaatggtacttacacctatatcggttccaaacctgaagaagacggcaaagccaagcaacccggtatcattgatacagtatcagatactgaaggttacattaaggtgaagtcgttgaatccctggcctgatacggatggtgatggaattcctgatatttgggaagaagcttacgggttgaatcctaacgatccgagtgatgcacaaaaaatcagttcgtcggttgatcctaacggacgctatccgaacatcgaagtttatttccacaacttggttcagcacattatctattatcagaaccaaggcggaatagtaatggaaaagaaataaaggtgtggagcaaataaatctatttacaataaaagcatagaatgatgaataaaataatcataagcatatttatcctgctgtgggtagcagtgggtgctatggcacagactgctaccgtgaccggtatggtgaccgacgatatggggccggtaattggtgccacagtaacggtgcaaggcacttcaataggtgcaacgaccgatttggatggtaaatttacattgaccagtgtgcccaatgtagccaaggccgtgttgatagttcgctatgtaggtatggaagaagcaaaagaaccgttgaaaggacgtacctcgaacattaatatccacatgaaagaagctgttggaatgttggacgacgtagtcgtaatcggctatggtacgcagaaaagaggtaatcttaccggttctatcgccagcgtatccggcaagatattggagaaagtacagaccacttctgctgctgaagccatcgtcggtaaactgccgggtgtgcaggtgacagctgtagacggttcgccggatgctgaaattaagattttggtacgtggtggcggttctattacacaagataacagtccgcttatcatattggacggatttgaagtaagcagtctgaacgatgttccacctaccgatattgaatctatcgaggtcttgaaagatgcggcttccacagctatctatggtgcgcgtggtgccaacggtgtaatcttggtgacaaccaaacgtcctgttgaaggacgggttgtcattagcctgaacacttatgtgcagaccaaagaactttccaacaaactggatgtgatggacccttacgaatttgtattgatgcaatatgaaaatgcgcgtcagaaaagctctaatcctacagcttttaataataagtatggacatgcttacgaacactacatctatcagggaaatgccggaactgactggcaggacgaggtgttcggttccaatccggtggccaaatatgtagaccttagtgtgaatggtggtacggagaaagccaaatataaactatcctttatccatcaggaccaaccgagtgtgatggtaggcaacggactgaaacaaaacaatatgaacgcttctttcaacttcaaaccttttaaattcctgacgttggaataccgcacgcgtttgttgcataaggaagtagatggatccggtacggaaggcgttagtttgttgactgctttgcgtgaaaaaccgactaagggtctggatgaatatatgaaacttcccgaagacgatacgtatttcgatcccgatcaactggaagaggaaactctttttgatcccaaagaagaatcgaaaagaaattataaaaagagaatcaacaagtcgctcaatacgatgggagccgtgacctgggatattatgaagggtatgactttccgtagtgaatttggtttcgagaataactctgaagaacaacgccgtttctggggtatggagaccagtaaagctcgtagcaacaataaccagccggtggcggaatggagcatgaaacaaggtaccaagtggcagcttaccaacgtgtggaactacaactttatgctaaaagaagcacatgatatccgtctgatgttgggacaggaaatcaagcataaccagactactaccaaaacttactctactcgtttttttccggaaaatatcacggcagaaaaggtctttgataatttgtcgctgggtactccttatgagaactcctcgtcagcggcctctccctctcgtatttcttcattctttggccgtatcaactatggctataatgataaatacctcgctacggtaacgctgcgtgccgatggttcttccaagtttgccaaaggtaaccgttggggattcttcccggcaggagcgttggcatggcgtatctctaacgaagactttttgaaagataatcaggtcgtatccaacttaaagttgagattaagctacggttcttccggtaacgaccgtatcgatgccgacctttatcagaaattgtatggggtaagcagttcccgtcctgccggatggggagaagtcagccactattactataacttctataactctaaatatgtgtacaatcctgatgtgaaatgggaaaccaccatcacacgtaacattggtattgacttcggtttctttaaagaacgccttagcggtacgattgatgtgtactggaatacagtcaaagatttgctggtgccttcggatattccaggttacacaggctacactaaactgatgaccaatgtgggacagacatccaatcggggtatagaacttcaactgaatgcctggctgatagaaacgaaagacttctcactgaacgccacattcaatatcggtcataataaaaacaagattgataaactggcaagtggtgaaaaagaatggattctcacttcggcctggagaaatgacgtcgtgaactctgatgattatcgtgcctatgtgggtggtaccagtggtttgatttacggttatgtcaatgatggattctataccgtagccgattttgaatctttcgactccaaatccagaacatggaaactgaaagaaggagtggtagattcaagcccattgtccgacactccgcgtcccggtaatgccaagttcaagaaactcactccggtagatcccaacagcaccaatccttatcagctgacagaagccgaccgtactgttattggcaacactactccgaaattctcgggaggttttggtctgaatgctacttataaaggatttgatatgagtatgttcttcaactttatgtatgattttgatgtactgaatgccaacaaaattatgctgaccacttgggcggacaataaagagaacaacttcctgatggacatcgcttcagataaacgctggcgtaacttcgacgacatgggtaatgagatccgttacagtccggaagtactggcagaattcaataagaatgctaccatgtggaatcccacttccatcggacgccccatctgtatgtcgtatgccgtggaagacggttcattcctgcgtcttaattcagctaccctcggttacaccttaccaagtgtgtggacgaagaaagtcggtttgagtaaagtgcgtttctatgtatcgggcaataatctgtttacccttaccggatatagtggttatgatccggaggtgaacatcgctaccggtttgacaccgaacattgattataaccgttatccgcgtagccgtacctatacatttggtgcacagttgactttttaattgaaatctataaaatgaaagaacaatgaataagaaactaatatactcactcattgccggaactatgttcactttgacgtcttgcgatgattttcttgatgtgcagcccgcctccggctttactcccgagtacatattttccagcgaatcggagatgaaagcgttgatgacccgtatctactcttccatgacggaagacggattgtacggaagtaaccttgccagcggtttgaatacgaataccgatgtggaaatgagttcgttcaagaacaacactgtcagtaccaatggctcggatataggctgctttgattcccgtcccacctggtcggtattgaacgctacttggaacaatatctattatgctatcaattatgccaacgactttttgcaggctgtgcaggagtcaccattgttttccgataaagtaacaggtgatactccttccgaaacacaacagatgtatggagaagtgaaaactcttcgtgccatgctctatctggacttgatccgtacatggggagatgtagtgtttattatcaaaccaacggaagcgaccgatgacttcttcagcctgggtactaccgaccgcaatgtcattctggaatatctgattgatgacttgatagctgtagaaccgatgatgaaatatgcagtcgatttggattatggcgtagaacgtgcttcacgcgaatattgccagtcgcttatcggacagttggctctctatcggggtggttggactcttcgtgccgacaaagaagatgtgactcacgtaggttacatggaacgaggtgataactttgaacattattatgagattgccatcacttatctggggaaggtaatcaaagaaagcaaacacgacttgactcaaagttttgaaaacttgtgggtaaatgaatgtaactggaagactgccaacaacgatgatgtcatgttcgctgttccgatgctgaaaagtgtcaccagtcgttatggctataatatcggtgttactattgcagaaggtaagcactcttatggcagcgcccgcaactatgtaactttctgcggtacgtatgtttattcgtttgataaggatgatttgcgtcgtgatatgacttgtgtaccttataaatatgataaagacctgaatcaggagattgatatgggagtgactggtatgggtgttggtaaatggtccaaactctatatgcagtctccgctgggtgcttccagtggttctaatacaggtatcaacagtgtacgtatgcgttttgcagatgttttgctgatgtatgctgaagcagtcaatgaactttacggaccgcgtgacgatgccaaagaagcactgaagcgtgttcgccgccgtgctttcgatgcggctcaatggacggataaagtagaaagttatgtagagagcctgactaatgaagcagatttcttccaagcagtcatggatgagcgtaaatgggagtttggtggtgaaggtattcgtaaatacgatcttgcgcgttggaataaatatggtgaagttatctacaatctttataacgagatgactaattggggattggtagctaacggagcttacgtaccaggcattgagaaagtaccgtctaatatctattacaagcaagtgacggaccctgaacattctgatagaaaggtattagacattgtaggtattgacgaatatggtcccggtgtaggtcgccctgccggttacacagtattggagtatgcgttgggatggagagtgttgaacaaagaaacacagctttatgaaacgttggatgctatttcatggagtttccgtggatttatcaacaagaacaacgatcaattagtgaaacctaccgatcctgtgagatacctgtgtccttatcctgcaaaggttataacagaccatcgcggattgattcggaactattatggatactaatcagtaaaaagacaaacgttatgataaagttattacgaaaacttgcaacggctatgctgcccgcactcctttgcggcaccctgttcataggctgcgaggcagatgataaatatacgaaagtggacgacctgttccagccccggtttgtattggagaaaccggaggtgaaagcaaactctgtgacattggtatggtataaagtgaacgatgctatctcttatacggtacaactacatcaggatcaatattataccagcttgtttatggagatagaaaccactgatccttatgtgtttatcgatgatattccttacggaactactttctatattcgtgtacgcagtaatgctgccaacgctaccaacaactcgcaatggaaatacaccagtgcctctactgaagctcgtccggaatatgcccaactggtggaagatgtttccaaaaccgaaattacggaatcatcggctatcattcgctggaagaaagacaataaacagaatccggtggatagtataagcattatccctatgatgaatacgacactgcctggtattagccgctatctgaccattgaagaaatgatgcagggatttgccgaggtggatggtttaacgaagaatacactgtatgctgtcaacctgtatgataccagtaaaccgcgtaaatatgacaaaccttataatcaggtaacgttccgtacggcaggcccgtcggctatgtccataccggtaggcttggatgacgatttatctgcgatgttgctgaacaacgatgtcgatcctgaagtgcccgaaggtacagaatactatttgcctgcaggttcttcttaccgcgtcactccgttcgctttgatgaaaggcttccgtttggccggtagtcgtgatggagttaaacctattgttgttttggaaggtagttggagtattgcagagggttcttacctctccagtctggagtttgataatattgaattccgtcatgaagcaaacaataactactttatgaataccagcaaggcatacacaatagagaatgtcagctttgtaaattgcgatttcataagtcttcgccgaggtttctggcgccatcagtccgctaatgccaagtacattatgaatctggaaatggaaggatgccgtttcgaaggttgtggatggcaaacaagtgcttatggtgcatttaatcttcagtctttcgacaaagataacggagtttcttatgaccaggtagaccgtgcaatcttccgcaactgtacatttagcaacgacaatgatggaaccaatggttatggctggggtaaccttttctatgctccttatatggataaacctatcgacctggaatataagaatgtaactatttacaactacagccgtaatcaacgtctgattaacattgaatctgccgtaggttctaaattggtaatggaaggtatcttgttggcatccccttgcggtgacttgtttgctatcggtgctaacactactactacattctctaataactataccaccgcagactatacattgggaggtaagaatatgaatgcgaccgatttgaaaattacggcagccgaactgtttgccgatccggctaatggagacttgacgattaaggatacctcttctccgattgtaagcaaccgtgccggtgatactcgttggttgccttaaatttaaattgagaatatgaacttacatgattaagaataaattaaaatataatattatgaatctgaaacatttatttttcttagcggttgccggaacgttggcagtagcttgtagtgaagttaatgaaaattctcttactgatggcgatggtcaaagaatgcttcgcactatcagttcgggcaacgaccgtttcactacacgattgaatagcgaaaccagtgaatgggagaacggtgatgctattggtatatatatgttcgatacggaagataagaatgtgttgaacgatgcccttaacgtgaaatatacgacgattggcgaggggcttacggcgaacttctcgtccgatcccggaatagcaatctatgatatgcctacgaatttcgtagcctattatccgcatactacatctgcagatgttattgatgccacagcagcactttataaagtagatgtaagcgatcagtctgacggtatctctgcccacgatttaatgtgggcaaaggctgccaaccagtcaacggaatcattgttggcaggtggattggcattcactttccatcataagttagtgcttctacgtgttaagattacgaatgaaaacgtgtcgaatgtgacaagtataacggtaggggggatgaataccacagctactttcagcctgatagacgggaaattgactaacatggatacgcagaagtctatttccctgcagaaaacaggagataaatcttttattggtatcatgttgcctgctgaagagttgataaataaaatgtcgctcactatcatggcagacggtggtaagtatcagtacacagtgcctgaaggcagcaagatagataagtttgttgcaggctatgagtataccttcaatatcaatgtaggaaaagagactagcggagaaataggcggtggttccggcagcaacacaccttggggtgatggtggcagcgaggatggcgacggtgataaagtttcagagaatgaagcaattcctgctgattatgctcaaaaagcgattaatgcagaaacaaacctgtcgacaatattgtccggtgcttccggtaaagttgcgttagtatttgctgccaatgcagaaggttatacctttagcgatgcaatggtagtgcccgaagctgtaacagagttgttactgattggtgatacagaaaaacaagtgaagatgaatctgaaacagatacaatataccagtcttcaaaagatagcattgaataacttagatattacaggtgataactcaaccgctctgctgactaacaatgaaactgcccaactcgctactgatgctgtggtagatttcaagaagtgtaactttagtaacatgaagactgtttgtgactggtcaaccggagataacggggcacaaaacttactttctgctgtagtgatcgatgattgtctgtttgccaatatgcaaaatgtcttcaactattatggttctaaagcaatcactatcactaactctacactttataaaatgacagaacgcgttatttacgtgaaagatgccaatagtgtagttatcactgtcgaaaattgcacattggcagatatggcaaagactccatttgaaagccgatatgcgaatggtaatctctattataagaataatatttcggcctgcttcgttacaagtaaccctaacataggctataaaatggatgtacgggaattctccggtaactatgcagcggcagctaccgaagccggacagatgcctgtattgaatgtacatggaaaagcaattgataccaatacttttcctaatgcctggatagatacgtccaaaacagttaccgaactgtttgaagatgcaggaaacggcaacttcaaactgagaattgatgctcaagtaggtgacccgcgttggtataagaatgtaaaataaccattgaattactcttgtaatactgattaaacattacagttatgaaattatttcattcattattatatcccttgttaggtggtttgttttgcctctcttgttcggatgatgagcaagattcaggtacaaaacaacctactactgcgggagaggttaccttcggtgtagacctcacaggtttctcaacccgtgtcacccaagacggatcgtcatggaatgacggagataagatcggaacatacgtattggatatgaagactcttgaacctgtcacagaagcagcgaatgtaccttatgtctgctcggaagagggtgcgtcggtttctttcacttccactacaccgctgaaagtgcaaaatgatggaacaccggtgaagtttgtggcatactatccgtataatgccgatgtacgtaattttaattatcccgtgcaactggccgctcaagaaagaggaagtacggcgtgcgacttactatatgctgccacgaaagaagaatacacctactctccggagaacgaaccccatatctcattaaactttacccatcgtctggcaaaagtgattctgaagtttgtgaatatggaaaaagaaccgttggaagtaagtgatgtacggattgaggggatgcaaactgccgcttcattcaatatacaaacagatgtactgacggttgacgaaagctctgttgctacaatcaacccttatcacaatgctacaacaggattctacgaagctatcattcttccatcggcattgacagacagctataaagtgtctttcgtattggacgatagagagaaagagtggatatttactaatttggacattgctttgccgcaattccacaaaggttatagctacacattcgcactctacatagacgacagcggctttgtagaaatgggacgtcttgaaaatgtggaaggcggaaactcatcagctccctgggaagacggaagcagtgaggacggaacggccgaaggtgacaagactcctgtatcaggatatgccttcacacctgccgacggcacgcagcaagcactagcagataccgaactgaaaatcgcctttgaaggcactgcacccgaacttggtacgagtggttgtatccgcatctatcgtatgagcgaccataaacaggtagatgaaatcaatatggcagaacgcagacagtctatcgtaaacggtcagacccaactgaatacgtggatggatattatcggcgttacgcctaccggttcttccgttagtcgtcgtatcgtcaattattatccggcacgggtggaaggtaagagcttcattatcaagcctcatcaacagcgcttacaacccgacaccgaatattatgtaaccatcgaacaggcagcagtgaaacaaacagacttcaagggagtatatggccgtgcatggacgttcaagacgaagccggcaccagcattgaccggaccgaactatgaggtgaaaattagtcacaccgaccccaatgctgacttctatactttgcaaggtgctattgacttctgtgccacacatgtcgatttgaatgctgctaagacattccggatggatgacggtatctatcaggagattatctacttgcgcgatcaaagcaacatcacagtaaaaggaaatgctagtgataatacggctgtcaatattcaatatgataacagcaatgatattaacggtggtataggcggcggaaccaatatcgatcagtttgcccctaccggcactattgtgccctcttccggaggtcgttcggtggtgatactcgatggtaacagtgataaaatccgctttgaaaatgtgacgatagagaatgcgtatggctggacactaggcaagaatggtcaggccgaggcactttatattaacaacaaatcggctgcttttatcaattgccgtgtcttgagtttccaggatactttgcttcccggtggaggttacaactggttcaaagattgtttcatagccggagctaccgatttcatctgggggtcgggtaaggtggtactgtttgaagattgtcagatccatgcacctagcggtacacgtgctgtaatgcaagcgcgtgtcagtgcgggttacttgggttatgtattcttgaacagccgtttcacggtaggcgaaggcgttactaactctactttgatttatcagtttgagccggacaatctgaccttcttaaactgtacgtttgccgatgtgtacggtcctaactttgtaggagagaataaaccgctgacaccggctgtacctactgttgccaccggctgcaaactttacaactgcaagactgaatcgggttctgatatttatcaatctattccggcaacggtgcgcaatacagtgctgcaacttagtaaggaacaatacgatcaatacttcggtacacgtgaaaccatcatgagttgggatggctataccgatgtggcttggttcaaataataaaatgtttaggtaaaaagatacgatgaatagattgaatcgaatgactggcttggtatcggtcatcataggactattttgtgcttgtcagggtactgccaagcaggtggatgtggagacagatttgaaggcaatgtatgcagaccttcctttctccatgcccgccatagagcgtcccgtttttcccgattatcaggtaaatatctgtgatttcggagcaaaaagcgatggggtgacgctgaacacggaggctattaataaggctatcaaagtagtgcacgacaaaggagggggtaaagtaatcattccggaaggtttgtggctcacaggccccattgttttgcaaagtaacgtcaatttgcatgcagaaaagaatgctttgattgtgtttagcggtgacacctcgttgtatccgattattacgacttcatttgaaggactggatacacggcgctgccagtcgcctatctcggcaatgaatgcagaaaacatagctattaccggttatggcgtttttgatggagcgggagacagatggcgtcctgtgaagaaggataaaatgacggacagacagtggaagaatctggtgaactccggtggtaatgtggatgagaacggcaaggtgtggtatcctaatgaaggggcattgaaagcatccgttctcatgtctggccaggggaatcaacaggctgaaatcacgagtgaagaatgggaggagatgaaaagttggctgcgtcctgtactgctaagtattgtgaagagtaaaaaggtgcttctggaaggcgtgactttcaaaaactctccgagctggtgtcttcatccgctttcgtgcgaatctttgatattgaatgatgtaaaggtgttcaatccctggtattcgcagaacggagacgcgctcgatgtggaatcatgcaagaatgtgctgattgccaactgtttctttgatgcgggagatgatgcaatctgcctgaagtctggtaaagacgaagatggccgtcgcagaggtgaaccttgtgagaatgtgattgtgagaaacaataccgttttgcatggtcatggcggattcgtaattggtagtgagatgtccggaggagtgaagaatgtatatgtgtccgaatgttcttttatcggtacggatgtcgggttgcggtttaaaagtgcccgtggacgtggtggcgtcgtggagaatatttacatcaataatataaatatgattgatattcctaatgatgctttgattgccgatttatattatgcggccaaaagtgctcccggtgaaccgattccgagtgtgagtgaagagactcctgcttttaggaacatctatatctcggatgtgttttgcaggggagcaggacgggcggcgtatctgaacggacttcccgaaatgccgattgagaatatttccatcaagaatatggtggttactggtgctaaagagggtattgtagtgaatcaagtggcaaagctcaacatcgagaatgttgaaattgacactcctgaccaatctatgatacagatcgaaaatacaacggatatcaccattaacggaaaagatctgggaacgatttcagagaaacggttgctgaccaagaactaactgtactactcgtttttatactgtttttattgtcaatctgtcagaacggaagttaaagaagtgaattacagtataatatatgttgacaatagaagctgacaataggctgacaataagaattaagagttctattgtcagcctgtttttttattgtatagttatgctgacatcttggaattgttgttttaaggttctgatatagttgcattcgtatgcctgtacagttgagtaagtatgtctgtatagttgagtaagtatacctgtatagtttgattagtgtgccggtatagttgggcaaaggtgccgctatctttaccttcccacggccgtggtagcttcttctcacggccgtggtgagatactaccacagccgtggaaagatctcgtcacggccgtgaagaactaacaagatcgatactttagcagaacgataacggcaccttagttgaacaataacggtgtctttgcggaataatgcaggcttggtaagtaagggataatagctgcatagtgcagttttaaacaataataggctgacaataaaagacgaaaatctttattgtcagcctattgtcagcttctattgtcagtgggtaatagcttgaaaacaatcactttatgaagccataactcttggcctgacaataaaaaccatttttttataaattctcaatgtagcctaagttcattaacccggcctcaaattgtatgtaatagcattgcctattgaatctgaatactgcacgtttgcaagtctttttcatttgaactgtttccgtaaagtatcttatatgttccgtttaaaggacgtatggtattggtcgctgcatcaaaccattcgaaagaatcgtacggaagctctatctggacgttctgtgtcttacctttagcaatgctaacccgttggaaaccacgaagagttttttgcggaccttctttgtcgtcaggacggcagatgtacacttgaaccacttcttcaccgtctctctgcccgacgttacttaccgggatagtaagaattgctttttcgcctttggtcagcttcgattggttcagggtcgctttcccataagagaaacgggtataacttaaaccgtagccgaatggataaagaggtgtttccgtcatgaaacggtaggtacgtcccttcatcgaataatcttcataatccggtaattgttgcatgcttttatagaaagtgataggcagacgtccggcaggattgtaatctccgaaaagaacatcggcaacggctgttccacctgcctgtccgggataccatgcttgcaggatagcatcgcaattctgcgtttcaggcacgatggccattgccgaaccggagaagttgacgaatactgttttctttccattcttctttagaagagcaagaacttcgcgctggatggcgggcaattcgatttctgtacggtcgccgcctttgaatccggggtcggatacccgcatggattctccttccaataggggggagatacctccggcaaagataactacatctgcgctttgcaacttgttcaggatttcacgggcatccattggagtttgttttgccaagtcgaagttcagtgtagggttatctttaacctgaataaaacgcaactcgatgtcgtaactctttcctgcttcgtagttgaaagaatacagattggtatgattcttgatgttggtggcttctgctatttgcttgccgttgaggaataaagtaactcctccgttagtcatcacgcggaaagtggcggcaccggaatctgttgggcggaaagtggaacgatagatggcggtgaagtttttcaatcctacaccgggagcaaatacggtagaaccttctgcactgaaatggaaaggagtggtcagacggtcggttgcggcaatcttgcctttatattcgcggttattccagtaggtggcgttgaatccggcttctccgtcgatgctgcactgattgaataggctgtgcagggtggtgtcgtttgtatatccgcatacaggttcgtagatgatttgtgcgtcaggtagtttggcgcgtattccttccagtagagtaacggtatgtgaagggaagccgttgtagttaccccattgcattaccgagtcgttggcgttggggccgatgactgcgactttcatctgacggtttaatggaaggatgttgttattgttttggagtaataccagactttcgtgtgccattttcagtgccagttctttgtgtttgggacagtcgataacagaaaatggaatgttactccagggatgagtcgaattcatttctcccagttcaaagcgggctttcagtagtcttttgactgatgtattgattttctcttccgaaatcaggccttttttcacagcatcggtgatgcttttgaagttaccgccacattcgagatctgttccgcttaaaacagcgtcggcagaggcatgggcggcatcgggatgcgtttcatgtttcttgcgttggaaaaagtctccgattgctccgcagtcggtgactacgattcctttgaatccccagtcgttgcggagaatttgggttaacagacggttgctgccgcagcagggatcgccttcgaaacggttgtaagcgcacatcacttctttaactcctgctttttgtaccagttccttgaaagcaggaaggtaggtttcccataagtctctgggtgcaatgttttctgcgttgaagctgtgacggttccattcgggacccgagtgtacggcaaagtgtttggcgcaggcatgaagtttgtcatattcggcatcttccggtccttgcagacctctgactgccgccattcccatacgtccgcttaaataagggtcttcgccgtatgtttcctgtcctcgtccccagcgggggtcgcggaagatattgacgttgggagtccacatggtcagtccctgataacgtttatattgtcctttttcattgaattggcggttcttggcgcgtgcttcgtcagatacggcatcaaagacttcgtataatagttcgtcgttgaaagaagcggccatacctatggcttgtggaaagacagtagccagtccggcgcgggcaacgccatgaagagcttcgttccaccattcatacggcttaatgccaagccggggaatagccggtgagttgttttgcatcaacgccactttttcttctaatgtgaggcgttgaagtaaatcgtccgcccgttgttccgcagttaatttcgtgtcctgatagggatacttgctgggttgttgtgcctgtacatttaccccttgaattccgataagacaggcaatgatccattgctttttcattttctagttcttttggtttttagatttgagactgcaatagtacgtgcttttcattatttttgtggggaatatccggtagaaaaggaggatttcctatgcaaggcttatttggagccgataaatccatagacctgttcaaagataaaacattttagctgaatagaacgtgaactttataatgtaaatagaaagatactgaaatgtttgtttgaaagggtatgtatgattgtcctccttttgtactgattattactctggcaggatggaggaaatgcttaatattgcattgttaattaagctcatccgggcgtttattcattgattaaaatgcgaatactatgatgtatcattcgacttgttcttttaagtgtttaccttatcttttgattctggggtgcatattgacgttcctgcaagcttgtgcacctgttcagagatatgtcctgttatcctccgataatggtgacggaacctataccaatccggtgattaatgccgattatcctgatccggatattatccgtgtaggggaggattattacatggttagttcgtccttcgtggcaatgccgggaattccggtctgtcattcgaaagatttgattaattggcaaattatcggtcatgcctatgacagtatcactttccagcctcaatatcggatggaaaatgagaaaacggcttatagccgtttgtgctgggcccctaccatcagatatgatgaaggcatttattatataggagtcaatattgcggatgatggcttcgtcatgtttaagagtacgaggccggaaggtccttatacgatgcataagtttgaaaagcggttgtatgatcccggcttttttattgatgatgacggtaaaaagtatgtcactcacggaaaagggaaaatctatctgacgcggttgaaagatgatgctacgggagtgctcgaccctcaagataaaggaacgctcattataacagctcccgaaggttacggccatttgtttgagggatgtcacacttataaaagaaacggatggtattatgtctttaatccggcgttggggtatgatggggtgcagatgataagccgttcacgaaacctttatggaccttatgaaacgaaagttctgatagatgatgatattaattatgccggtgcaggtgttcatcagggtgggtatatagaaacggctgaaggagaatcctgggcatacacttttcaagatcgcgattatatggggaggtgtcttatgttatatcctatgaaatgggagaatgaatggccggttgtcggaccggaaggcagaccggggaaaggagtggttacttatcggaaaccggcagtcaaaggtaaacataagatgaattatcctcatcattccgattcttttgacaaaccggaattggctccggtctgggaatttaatcatgttccgtataaagagaagtggagcttgacggacaggccgggttattttagaatatatgctcaacatgccaaaggtttttattgggcgaggaactcgttaactcaaaaggtgacaggaccgtatagcacgggcacggtattattagacttgtccggtttaaaggaaggtgactttgccggaaatgggattatgggaagaatgatgtatcaatttggagtcagaaagaaggacaaccgcttttggcttgaaatgagaaaagggaaccggaatgcggcagagatgattgtggatagtcttgaattgaaagatgttcagagaatttatctgcgcacagaaacaacgaaagaaggggctactcgttttcattatagtttggataatcgccaatatcatcgtttcggtcctgaaggtgtttctaatttctggggatttctagggatacggcatgcactctgttgttataatgtaatgaaaggaaatccttgcggatatgccgactttgactcttttgaactggaaagtgcgcatcgcggcaatcattatgatgcatttacggaaatagacttctttcgttatgacgaccgggaagggatgacattggttcgtcctgtcggcaaacgtccgatgcaatttctaacggatataaaggacagcgattggcttgtgtttaataacttgacatttaagaaaagacccggaaagataacattcgaactgcaggctttgaatccgggaggagttcttgagatgagaagaggttctttacaaggggaactgttggcttcttgcactattcaatctactaacggggagtggacgaagcagagttttgaagtaaagaaattacgaaagaaagagaaagtctattttgtgttcggaggttcaaataagagcttatctattaagaatttcatatttgagtagaatatccagcaaggtcatatatcgaacctttatcgaaatagaaaatcactaaagtaaaggttttagaggataatcatagctggcttatagatatttactacatttgcgaacgaccggtaatacttccggttatttatagaatatccttttggtacattgtgcgttggggatattcttgtttgtataagaaataatagtaaataatggatattggaggaggcaaatgaatagtgattataaagttggcgatttaatttatgatgcaaatatttatgatggaatgaataccagcatggatgatttgcaattttataagcggtggttacctaaaaacaaggatgcccgaatacttgagctttgctgtggaattggcagacttactcttcctattgcaaaggatggatatgatataagtggggttgattacactgcttcaatgctccatcaggctaagatgaaagctgccgaggctggactaagaatcaatttcattcaggcggatatcaggactctggatttacagaagaagtacgaccttatttttattccatttaattcgatccatcatttatatgagaatgaagatttatttaaggtacttcatgtcgttaaaaatcacctcaaagacggaggcttatttctgttggattgttttaatccgaatattcggtatatagttgaaggtgagaaagagcagcaggaaatagccacgtatacaactggcgatggaagagaagtctcgataaagcagacaatgcgatatgaaaataaaacccagattaatcggatcgaatggcattattttatcaatggtgaattcaattctattcaaaatctggatatgagaatgtttttccctcaagagttggattcatatttggaatggaatggttttagtattattcataaatatggaggatttgaagaagaagtatttaatggtgattcggaaaaacaggtgtttgtttgtcaatgtaagtttggatattgatgtgttgttgacaggcaaatctctttatcttgtatgaaaagtccctttatatcagtttactctatcgaatttcgattgatcgaataatgagacaaccgggtataaagggactttttatattcttatcaaagagttatttttttctctctttgtattctgacggggtaattcctatcactttcttgaagcacttgctgaaatatttcggatcgttgaaccccgtcatatatgctacctgggagaagttatattcgtcgctgtcaatcagttgtacggcacgtttgatacgtatttcccgtataaagtcaacaggtgtcagtccgacgattgattttaatttccggtagaagattgtacggctaagcatcaactgttctgcaaattcgtcaatcgttagttcggcattgtccatctgttcttccatgtatgccattacttttttcataaattgctcgtcgtatggagtaatctgtggttgtgaaggagtcagaggatcgggagaagaggtattctttccttccatcagcctattcatatagagttcctgcaatgctttgcgttgtcgtaacaaggaggctacacgggtctttagataagtagcactgaaaggtttggtgatataatcgtcaatgccttgttccaatccggcgatacggtcgtccagagaggccttggctgataatacaatgatggggatatggcaaatattgttgttctctttgatttgcctaatcatttctaaaccgtccatcaccggcatcataacatcgctgataataagatcgggcaggtcgtcaacagcatgttgcaatccctcttcaccattggaagctgtgattaccgtataattctccgacaaaatacttttcagaaaagcctttaactcttcattatcttctaccaccaatatggagaaaccatccgaattagtctcaaggtcttctttttcttccacctcttccggcgctttcatgctatcgacgggatgaggcgctgaactctgactatcattcaggataaattcgacctgtacatcctcctcgaaaatttcccgttgtaaaggcaagcttactgtaaaacggctgcctactccgggttgactatttactgtaatagtgccatgatgcatttccaccatctctttcacgagagacagcccgatgccggaagatggttgcagaatattctgttttaccaatgactcgaagcgttggaacaaggaatgttgcttttctactgcaattccgattccttcgtctgcaacctctatctctaccgtcttctctttcgttgtgatattgactgtaatcgacttgtcggcaggtgtatatttgaatgcattggaaagcagattgaagaatatcttttcaaacttgtctctatccacccagctatataccgactggatggtagaagtcagctgatagtttatgttcttttcttcagctatcagtttgaagctactcatcaccttttgcaaaagtggaatcaaatcggtctcttcaatcagtagtttcattttctgattctgaatcttgcggaaatccagaatctgattcatcagtcggagcatgcgctctgtgttctgatgtaccaaagtcaaatgctcacgggcggaaggagaaagcggttcattctctaatacctctgtcacagggctactgattaaagttagcggagtacgtaactcatgagatatgtcagtaaagaatcgcagtttgatatttgctaattgttgttccatatccactctgtgacgtaaccgatagatgtaaaacaacacatatacgatgcttgccgtaaagagtatgaatagaatgaaatagagcagccatgcccagtaggtttcccaaaaggtggggagtacatgtatagatagagtccgtacattgtccacccagaccccgtcactgtttgttgactttatctgcaactgatatttgcctgcaggtaagttgatgtagctagcggaacggttattatctgcttcattccattcttcttctagtccttgcaggcgataggcatataaaatcccttttggattgacataatcaagtgcagcaaactggaaagttacattcctttgagagggctccagttccaattcttccagattgtcaatagagtgatcggtaaggtgtccttgaatcttgagtcctgtaaacacaataggagggacatagctactcttccgcatcttctccggagaaacttccagaaagcctttatcagttcctaagataatttggttacgggcattgataataggaagagcttcggagaaattgaattcctgatagatggaacttaattcatagttctcaaaagtttctttggcaggatcgaatttggagagcgcaatctccgaaacaacccatagctgattctgtgtatcttcaatcattgatagtgccaaatcggaagccagcccgttgttcttgtcgtagtttctgaattggatattctcgttcagcagattgggagatatcactttatttacgcctccggtgaaactgatgatataagtggttttattcttgtctgtatagatatgcatgatatcgttggcactaagactgtttttatctcccggtctacggatattccggtagaatttaatctcttccaggcgttcgaagttgttcgagaatgtcagcagtccgttagtcgttcccactaaaatcactcctcccggagcttctgcaatattgcgtactttcataccgtaagctatgggatagtttcttaactcattattactatgaataaatgaaacttttccatctttagcttgtgccagcagatttaatccacccccataacatcctatccaaatatgattacgactgtcctgaaagatagcataaatactattactgcttaaactataaggatcatttgtctggtgttcaaaatggtgaatagagtaatgatttgctcctgtctttttaagttggaaaagtccgatttctttagtccccaaccatatatttccatctttatcttccagaatcgaatataccccattatagaacgattgtttttccttaatgatatttccttgtttggataagtaccccaccaggttaccatccggtgcgaatatctggatataattagatttcgatgctgtccatagacgtttattgctgtcttgcaggaatgcacgtgtttctgcctcgtaatcagtcaggttaaattgatagctctgtggaaagaagcatagtttctctacaccacgtgctgttgcaaaccaacagtttccctgattatccaatgtataagacctgactaacggactgaaaatagacttaggattattgatatccgtaagaagcggtttgagagttctttctttccggtcatagtagcaaaagtttccttccgtggggagtaaccataggtttttcgcattatcttcaaaaataagtttgcgacttttacgcccatgcttgataatctcatcttttggggtgaacagatgctctttttcattggtcacgaggttaagatggacaatgcccggatcttttgaaaaaatccagatatctcccaagtggtcttgatagacagattctacatcgttggaagtttgggtagctgtacggatgtctatttgctggaaactgttcttcgggatagaatacaaaatcactccattatccgttcccaatgccagcatatcttttcctatggtagtgacattgtttattttatgatgcggataaggaatatctacgaatttcagttttttagtgtggaagtcatatctggctaacttgtcattttctgcaatcagatagatcgtttcctttatttgggtgatgaactggaaaggaaagtcagtatccagtgttttctttcctatgatggaaacacctttatccgtcaatatccattcatcttcttcagagtcttgataaatgttaaatatttgatttcctttcaggttgtggttggaagctgaataaagtgtgatgccttctccttttttgcataattgttcgtccactctgaatgcatatccgctttcacagagaatccaggcaatccctttctccagcgaataaatgcgtgtaacattgttagtttgtttcgtggaaagttcaataggttggagaacatcaataaacttctcggtttccacatcaaaaagacaggcttgtccatcgtaagtggggcaccatatatctccgtatttgctttctgaaatagttcccatgcgattactgccgaatgcatatttactctcttgcgaagttttatatgtcttaaaagtgtatccgtcaaacttgttaagcccgttccaggtactaaaccaaacaagccctttctgatcctgtaaaatgctcattacattaccttgagcgagaccgtcactcacggagaaatgtttaacttggcagataggttgagcagctatatcgatcgctattgttagaagaagaaataaagtatggagccgtttcatagtagttactttaatgtttatagcaaaaataaacaaaacaatgcagaatggaaagtccgataagtggtttgaacgaataatactcgttttttcctattttttcctcttcatcctatacagcattgatctctatgttgtgttttgaacaaaaataagagagtaatattagttaaaaaaatcctctttataatctgaataagattataaagaggataattttattgacaagagttgcatggggtatggtgagatgaaatcataattggggaataaattgcacaagactttcacaagtatcctcctgccaatacctaaaatcatagcaaagctaattaaatagtttttcgaattgcaatatttattaatttatcttatggtatttatgaaatttttaatatattgaagatattttgtgccaactttccgtaactcgttgattttgcttatgtttgtaggtaaaataaagaatgaagtgaatgaatatgtctacacagctattatataatgatttccctacttttttgcggaaatattttccttacaaagtacaaaagatttcattgaatgcaggtttcacttgccccaatcgtgatggtacaaaagggtggggtggatgtacttactgcaataaccagacttttaatccggattattgtcggacagagaaatctattgctattcaattggaagaaggtaaatgcttttttgcccataaatatccggaaatgaaatatttggcctattttcaggcctacaccaatacatatgcggagttggaaggcttgaagcgtaagtatgaggaagcattggcggtggatggggtagtcgggctggtgattggtacgcgtcccgattgtatgccggaaagtttgttgcgttatctggaagatttgaacaaacatacgtttctcatggtagaatatgggatcgaaagcacttgtgatgaaaccttaaaacgcatcaatcgggggcatacttatgcagatacagtagaagctgtgtgtcagacagcggcctgtggtatcctgacaggtggacatatcatcctcggacttccgggagaaacacatgatacaatggtggcacaagccgaaattctttccgatctgcctttagctacacttaaaatccatcagttacagttgatccgtggtacgcgaatggcgcatgagtatgacgtaactcctgctggctttcatttgtttaacgaggttgaggaatatattgatctggtgattgattatgtagaacatctccgtcccgatatggttgtggaacgttttgtttcccaatctcctaaagatttattaatagctccggactggggattgaaaaattatgaatttgtagctcgtttacaaaaaagaatgaaagaaagaggtgcttatcaaggtaagaagtatagggattcggaaaaaaggattatttttgcaaacgataaacttaccacttaataaatagctgttttgcggagtatagaatagtggaagaaatatttaatggatttgaaagatggaaagtaaaacaagaattaaaggaaatgtccactatgtgggagtaaatgaccgtaacaagcacagatttgaagcgatgtggccattgccctatggagtttcatataactcttatctgattgatgatgaaatggtggcattgatagatacggtagatatctgttattttgaagtctacttgcgtaaaatcaagcaagtgattggagaacgtcccattaattatttgattataaatcatatggaaccggatcattcgggatctatccgattgattaaacaacattatccggaaattattatcgtgggtaataagcaaacattcggtatgattgaaggtttctatggggtaaccggtgaacaatatctggtaaaggacggtgatttcctcgctttaggacgtcacaaactgcgtttttatatgactccaatggtgcattggccggaaacgatgatgacttttgatgaaacggatggagttcttttctccggtgacggattcggatgttttggtactgtagatggcggattcctggatacccggatcaatgtcgataagtactggggagaaatggttcgttactactctaatatcgttggtaaatacggaagctccgtgcaaaaggctttgcagaaattaggtggacttcccatttctgccatttgttctactcacggacctgtatggacagagaatattgcaaaggtgatcggcatatatgatcgtttgagtcgttatgatgcggatgaaggtgttgttattgcctacggaagcatgtatggaaatacagagcagatggcggaagctattgctgaagagctttctgcacagggggttaagaatatcgttatgcataacgtaacaaagagtcatccttcttatatcatagcggatattttccgttataagggattgattatcggttctcctacgtatagtaatcagatatttccggaggtggaagcgctgctttcaaagattctgctgcgtgaggtgaagggacgctatttgggttacttcggttcttttgcatgggcaggtgctgcggtgaaacgtctggcggagtttgctgaaaagagtaaattcgaattgatcggtgatccggtggagatgaagcaggctatgaaagacctgacttatacccagtgcgaaaatctggcacgtgccatggcggaccgtttgaagaaagatcgttaaaacagtgaatgagataatttattaactaacctataaaataatcgacttatgagacttattattcagccggactaccagtccgtatctctgtgggctgcacattacgttgccgctaaaataaaagctgccaatccaacccccgagaaaccatttgtattgggctgtcccaccggatcatctcctctgggcatgtataaagctttgatcgacctgaataagaaaggaatcgtttccttccagaatgtggtaacattcaacatggacgaatatgtaggattgccgaaagaacatccggaaagctattattctttcatgtggaataactttttcggtcatatcgacattaaacccgagaatactaatattctgaatggtaacgctccggatctggatgcagaatgtgcacgttacgaagaaaagatcaagtcatacggtggcatcgacctgttcatgggtggtattggtcctgacggacatattgcattcaacgaaccgggatcttcattgacttcacgcactcgtcagaaaacgttaacaatggataccatcattgctaactcccgtttctttgataatgacatcaacaaagttcctaagacttctttgacagtgggagtaggtactgtgctttctgcaaaagaagtgatgattattgtaaatggtcataacaaagctcgtgctttgtatcatgcggtagaaggtgctatcacacagatgtggacaatcagtgcattgcaaatgcatgaaaagggtattatcgtttgtgatgatgctgctacagctgaattgaaagtgggtacttaccgttacttcaaagatatcgaatctgctcatttggatccggaatcattgattaagtaatttgtaatgaaataatagaaataagggctgcgcactgaaaatgtgacgcagccctttttatttctgatactattatgtgaagattagattttggatgattgtctaacgagcaagtattttggctatttctgttgctgctactttatatccttcaccagtgaaatgaatgtaatcatttccataaagtccgtctttcatagttccgtccgcttcggtgaaccatttggtgggattgatatattcaactttctcgaatcggtgatgttgtaatatgtcatgaatcttatcacattgtgtgcgcactttactctgttgttccttaccggatggaaacagacctaaaagaatgatacgtgattcggggaattgcttccgtacttcattggctactgcgataattccttcagccgtgttttcgggactgtcttttccacttatcagattattaattccaatggcaatcactatgttttcagggtggcaactattgtagttatcataacggacacgccaaagcaggttttgcgtgcggtcgccggatatgccggcactttcccaattatcctttcctatggcattgtccatagcctctttgccgggcttgtaagtcacttcttttctgttacctccccaaccttgtgtgatggaatttcccaataacaacagttttaaatgtttcccattgagagtggtggttatgtcttttgctacgctgttccagtccgagttttgggtccatccggctgccgaacggaattcatttcccggtacaggatgcacacacatattttccgccctgttcgtagctttgaggatgaactgcacaataggctcgggattgttgagggagtgcgggtgatgatccactccaggcttatgaataatagtaattggtgcatgcaattcctccatacgttgttcgaaaatggctgtgttttcagcaaccgacaccacttggtcagcatcacctaccacgtgcaggatggggattccggcttttgccattgtcggtgcacagtctatcggattctttttccagttcaacgcttcagcttcgtttttaaaaccgtaagcattgagaagttgtttcgtatccatggcggaaccggcagatttaccttgtcccataggccaacttttgaagtccattacgggggcatctgcataaatacatgccactttttccgggttttgtgccgcccagttatagacaatcagcccgccacgactcatcccttcaagtgccactttcttgttgaatccggctttcaccattcgcttgtaaaaactattccagcgttgaacagctttatccgagccatataagtcggctacatcacagtaaacaatatgaaagccatgttccaataatgctatgtcagtctgtggctcatgcccccaaaagcgtgcacgaatcatccaaggttttcctatggcttcttttgcgggctctactacaaggcattttactccctcattctcaaattcatacccttggtgtccatggaagttgaatcgtttggcatcttgtattcccagtgatgtctgcagctttgttggagaagctgttgcttttacagcgagatattcatatatcttttgggccatgactcctgctccgatagaagaggggtgcagtttgtccggtagcataaccgaatcccactggtcgccgaagagattaaacagattgataatttccagttgatttttccaggccaattcttccaccgtggggcgtacctcgttttctatcagttgtgcattgatttccgaaccctccggcaggaaacaacggataggagtcaggagaataatacgtggatgtgatttcagattccggtatgtgtcaattaatgtctggtaattgtctttgaattcgtttttgtatttccagttttgcggtttggtatcgttagtacctaatttgattaatacaatatcgggctgatattccagagatgctttgtaggtatctgtttcggaatatgggtaatctcctttagacaatatagttcgaccagaggctccgaagtttttgacctcatacccatctcccagataagcttgaagttgtgccggatagcagttcatttcccggttggggatgaatgctccataagtaatactgtttcctatgcacgctacccgtatgggttcacttgcaaatgattggatagtaatgaatagacatacaagaaagatgccgatgtgatttaattttttcatgatgaatatgatggttttggtttgttggggggataaccaatcgttgttttgctgtgtataaacgaactggcatgctactaataataaaacttatttattcacgttcctatcatatagcataccagttcgattcatttttcggcttttatacctcttccagccagcctttcccttgccggatgatttccagttcgtcgtcggtacatttcactacagtggaaggttctatacctccgatacctccgtcaatgaccagatcgacaatgtcaccgaacttctcatctatcagttcgggatctgtcatatattccaagtcctcatgctcttcgtagggcagagtggtcgtcataatgggagcatccagcaggcgtgcgatttcgcggatgatattattatccggcatacggatacccacttctttccggttgcggaagattttgggtaaccggttggttccgttcaaaataaaggtgaatggccctggaagattatgcttcatcagcttgaatatattattgtctactttcgcatattcgctgatgctactcaagtcataacagatgatagacagattgttctttctagggtctatctctttgatccggcatatccgttctatagcacgttccttcaaaccatgacagccgatggcgtacatcgtatcagtgggatagataatcagtccgccgtcattcaggatgtcgatgattcgttgtaaatcctgcgggttattatttttgtcatatagcttcagaagcataattcattctccttctctcttatttgagtttcttttttaagaaatccagtgccttttctgctgctttctctgtcaccttttgtttgattgaatccttattggcggtagcggcagagtccagtcccagtttctgtccgagtttgctgatagcttcatcggctacagcctcgacagcttgattggccatgcttttagtatcgacgctgactttcggagaggtaaatgaacctccgatcttcaagtcaagagtcattagtttagagatattgcctacagatgtcggcaacttcacttttccggagtagtcgatggtttgatcgaggcctgtgctaccggaaagattcaatgtgtagtctcccatcttgatatcgaacggtttggtttctacgcgtccgtctttgatggtgaaatccagtgtcatatctttcaccttcatgtctttcagacttggctgtttaacggcatcggctatttcgtcgattgctttcactccgctcaaactaagatcacgggtggaaaggctgccatcaccttgcattgtattcagtacagggctcatggttgcatccaaatctgtcagtatattaatacttccggagaaattacctttcaggttttcgaagataggagccatcttctgcaccatgtccaattctttgtaagcttgtgcgaaaccgatattggagagtttgaatccggctttcatttccggcttctttacgttggcagtggagtagtagccgttcatgaccacgttgccacccatggtgttcatggagaggtttttcatatccactttgccatcttttaccacaagcttgccgttcatattattgaaagacatcttatcgaataacacctgtttcaggttagcgtccatttggaagtcgatgttgcggggaacttccataatacccgtggcagctgtagctacggagtcggtagacgcagtttctgatgcagtcgcttcatccgcagaagcggccatgaagtcgttcagattgaaatagttggaacgaatattcaggtttcctttcaatgtagtacctttcaatgcgtaaccgatatagttttcaaaccgactgtcggctgtgatatcattctttccgatgttgacggttgtctcgctcaactggaggtatttcggggtgaaagtgaagagagacttcttgatttctacgtccggcatatctttcattttgagtttcatacccgtcagtccgatagtacctgaagcttgcatacgttcgtattcctctttttcgatataggaaaggcgtcctgacatttgcatatcggcgtcaatggtaccgttcaactccatatctccaagtggatagacttgttttatcatacctaaattgagaatccctttagcttcagctttaaagtccggatcgctgatcggtgtttttacattagccgtcaggctaaacggatttccggcaagacggaaactgaaaggattgatattgaccgtcgtcaggtcgatatttcctcccgggttctggacgttggcactgatattgatttgatccactcctgccagtaaagccggatagcggaacatggcattcttgacttgcatatcaatgttgaatgcaggaacggtgtcgccttgcaagatacctttggccgttgcagtaagcgtagcggttccgtctgttttcagactggagaattccgttgcataaatggctggaatcagtgacaagatttccttaaacccgatatcgttcgtgttaagtttcaagtccatgtcgatagccggatctttcaaggctacccaaccgtcgatacctgcctgaatggcgttgaggcggatggtgttgtcttttaatgtgtatttgttattggcaaggtcggcatccacatccattgttgcggagatattggcattggccaggaaagggattccattcatcttgtaagtaagtgatttggtttccgcttccaacttcagagtagtgcggtcacttcctaagtctccggcgcagactgcgttaaagtcgcggatatcagcatacatcttcccttgttgatcgtcataaatcaggttcatgtttttgataacaaagcgttgtagcttcactttgaaaggagaagatgcttcttcttctgaaacaggagcttcggctgttgctgttgtatccggtttcataatatcccagttggcacgtccgtccggcaatacaatggcatgtaaacgtgtatcttcaataaatattttagaaatatcgtaaccgctatctccgaaaagagagaataagttgactgcggcagtaacttctccggcctgtacaagggtgtcgttggcaaattcaccagtaccttttaaccagaaatcctcgagagtgacagaagcctgtggaaagttacggaacaggctaatgttaaggttcttaaagtcaaattgtgcattaagcatcttgttgccttctgtttttacaatgtcggctatctttccctggaaggcgaaaggaagaaggaacatcagaatgatgatgactcctactgtgatagctgcgattttcaaaccttttttcatttgcttctattttaagagtttgagatattacaaagagcaaaactaataaaagtttttgatatagagggagaatcagttctttttctttcgtcttgatacgaaagaaaaggaaccaaaaagaaagaatcaaggctgcgtttttccgactactccggtgtttcctccggctaaagggcagaaactcgctacgctcaaacagtctgccctttttaacgccggagaaaccacctgcgcttgacgtcggaaaaacgaggccgggaggccatgcgggggcactgtttgatggagatattgtgtgtaggatgatttttatgtaagtgtgtagatgacaaagatggataggtgcggaggtcgggaagaataggctattttttctttctaagttcttctgcaattctccattgtaaggcggcttctccttctttcccgactttcaacagagcgtctccgaagagttcgtgtgcaccggcatgttccggtttcaggctagtggccttgttcaggtcggcaatggcaccttctgtgttttctgtttttagccggagctttccacggttatagacagctttaaagtttgccggatagagggtgactgcagtgttgaagcagttttcagcatcgaaatactctttgttgttgaagagagtgattcctttgcgtatccaggcatccacataattagggtcgagactaagtgccttgtcgtagttggcgagggcggcacgtgagtcgtgtgcctgggtgatacattcgttacccattaatagatattcgtgagcatattggcggaggcgttcctgctgttcgcgcatttgctctttgagtttcttattctgctctttcaaggtgtttatgacaccaagtttacgtcggataaaacggcggggaacagatttctcaatatcatagcgggaatgaatggcgcggaaaaactgttccagacattcctccatgtctcctttgtcgaaagcgcgtgaagcagcagcgtattgcacgtcggcctgcgcttgtttcagagctttgtcgatagcctgccggtcgttgaaacgtccggcaaagtttacgatttcggggcggacgaagacgtcagcacggttaataggctttttgagctgaataccgtccagtgaggtacagcggcttagtgccacgtatgcttgtccacctgcaaatacaccacctgtgaagtcgatgactacacggctgaaagtcagtccctgactcttatggacagtgatggcccaagctaaccgaatgggatattgtgtgaagctacctaagacttcttcttctatttcttttgtcttttcgttgtagcgataacggatattgcgccatgattcacgctttacgtcacattcttttccatcgtcggtgataacgtagatggtttcttcttcctcatcaattccggcaatgacaccaatggtaccgtttacccacctgcggtcgaaatcatttttaataaagatgatttgtgcaccgggtttcagtacgagctcttgtgaggtgggtagactgctttcggggaaatctccttcgatgactccttcaaaagtaattgggtctccgggaagttccgccagtttcttttcgttgatagagtctaccgtgtctctacgggtggccagagtgatatacatatcagcttccgattcttctatctggcttccataacgggtgttcagtagttgcagatcagccgctccggctgtattgttccggatatggtcgaggacgccgacaaaaacggggtctgtttggcggtataccttttgaagttcgatggataccaggtctatctggccgaatactctggcagagaaaaaatagggtgtaggatagaagcggttcaatatttcccgttcgtcgttttttacgacgggctccagttggaatacgtcgcctaccaataacagttgttttcctccgaaaggttcgcgcagattatgagagtatacacgtaggattcggtcgatggcatcaatgatatccgcccttaccattgaaatctcgtcgatgatgaccagttctatttgttccaacagcttccggtgaggcttggtgtatttgaaaaattcatggatacgaccacgctggagactcaagttcgggtcatccggcagcagcggatagaaagggagtttgaagaaactatgcatcgtacttcctccggcattgatagcagcgatgcctgtcggggcgagtacaacgtgtttctttttggtattttcgcagacgtaacgcaggaatgtagatttccctgtacccgctttcccggtcaggaaaaccgattgacgcgtatattgaatcaggttcagggcgtcttgaaacgctgcgttattggtgtctacgctcataatcagataataccaaaatgcttcattgccttgctgatgccatcctcgtcgatgggagctgtcacataatcggcagcggctttcacatcctctttggcttgtcccatggctactccgatggctgcatggcggagcatgctgatgtcatttcctccgtctccgaaagccatggtatcttcgagtttaatatcaaaatagcggattatttcatcaatgcccttttgcttggtgtctcctttggcggtcacatcggcaaatgcaggataccatcggcctatctcgcaggtaggaatagacggacggatttctttttcttcctcttccgtgataaagggtgtcatttggatgacttccttactggttgcctcctcgaaagatacagtcggaatcacattcacgtgcaggaaatcatagaatatctttttcaccatgtcattgggctggcaaacggaaatgttgtgttcctctacaaagatacagggaacgccttttttctcgcagaaatctcccatcgcttttacttcgtcctgggggatggcacttttatagattacctgttccccgacaaagcagtaagccccgttcatggtgatatatccatcaatcagattccggtcttgcaattcggagaggttgttgataatggctttcggacgtcccgtagcgataaatatcttcagtccttttgcacgggcggcttccagtgcctcaatggtagacgacgggatgcggtgagtttcaaaactgaccaatgttccgtctatatcaaaaaataatgctttcgtcataaattcttttttgaatggagtacaaaagtactatttttctatgtaaatagcaattaggagatttctcttatgctttttttaagtctctactcttatcgataggaacacaattatttaaaagtgcctaataaaatgattaattataataggttcctttattcttttgactaaaaaagtttcccaagcatggcatcaagtctttattcttctaacgaattctccttatacttctctccatagagttgctggtactccttttggaaacggtcataaacactttgtgcatacgctttttgtccaagtttcttgagtgcttttattttgaaagtcaatgccgtttcgctcattccgtcaaacgagaaaagcacgtcggacaatacgataacctttctgggttcattattcgcttctacgataggaagcagtttctcgatgatccggatgaaaagttcgtcatggttaattttgatattgccaaaccattcgtaatgtacaaaagtaggcagtaaggtgcctcgttgcagcaggccgataaatcagaatcctaattattaatgggatggcaattatgcttctttctgttttaataagacgggatattgcagaacttgataaaactaacagtctgtccggatattcccttggggagatttaatcgggctttaaaaatcttgaatcaatgaaacaaataaaatatttatcctttatcccttttctagctcttctctgcttgatgacgggatgtgaaaatgacaaagatgtgtattacccttatgtcaatgttccgcttactacgcacaatccggtgctcgttgagggagaagtcctgcatatcggtattggtttggacggtgtgaattatcgtgtagagagtgataatgaggatgtggtgactgccgaggtggttggcaacgagatactgttgacaggcagtgacataggtagcaccatcgttcgtctttcggatgatagctacaatcgtgctctcatgacggttgaagtacgtaaacttcaggaactgacactcgaatcgctcccggagggagtggaagtattgcgtctggataatgacggtgttattcttcgtgaaatgaaaatactgaccggtaatggcggttataccgttaaatctctgaatgaaggggtagctactgtggcaatctccggcactacagtaactgttactgtggtaggtgacggtggtacaactattactgtgaccgaccaggaaaaggaaagccgttccatagatttatgggtaccgctcaatcttgacgacccgacgccacgtatttattgggatggttatcgtgccgatattaacacggccggagtttccagtaccggatcttatgcgacgccaaaagatatgtactggtatcaacaaaacggtgaagtgaaagatacatattatgtctactttaacggtggttgggcaaacaatttaaattgtgtgaatgctgccaaccgtaatccgaagtttgaaacgactatcaatgacactaagacttcgtatacagacaaagcagcctctgccgttaaactgaccgagtttattttggaaaaacgtatcggtacaggtccgacgagccatccgcatatctatttcatctctttaaaaacagaagatggtaagcgtggatttatagtgcatcgttggaatgaataataaagacaaataggttcttagttttttttcagggtatgaatatgagggtcggatgctgtattgctccggccctctatgttttgatagagcatacaaaattagaggctgcctttcggtaataccacgaaaacaactatctttgctaactgtttattatacacataacctaacaatattatgcagtatgaactataattttgatgaaataataaaccgtcatggtacagattccgtaaaatgggatgcagtagagaatcgttggggacgcaatgacctgattccaatgtgggtagctgatatggatttccgcacagctccttttgtcatagaggctttgaaaaaacgcctggagcatgaagtactcggatatacatttgcttgcaaagaatggtcggagtctattattaactgggtgaaggagcgccatggttgggcaatccgtgaagagatgttgactttcactcccggtattgttcgcggcttggcttttgtgatccactgctttacgcaaaaaggagataagataatggtaatgccccctgtttatcatcctttctttttagtcactcaaaagaatgaacgtgaagtggtattcagcccgttagtcctgaaagatgaacaatattatattgatttcaaccgcttccgtcaagatattcaaggatgcaaattgcttattctaagcaacccccataacccgggtggacgtgtatggaccaaagaggaactgtctcaaatagccgacatctgctatgaaagcggcacattggttatctctgacgagattcatgctgacttaaccctacctccatacaaacatcctacctttgctttgatttcagagaaggcacggatgaactctcttgtctttatgtctcccagcaaggtattcaacatgccgggattggctagttcttatgcaattattgagaacgacgaacttcgtcaccgtttccagacatatatggaagcaagcgagtttagcgaaggacatctctttgcttatttaagtgtagcagctgcttacagtcatggtacagaatggctggaccaagtggtagcatatattaaaggaaatgtggatttcactgaaacgtatttgaaagaacatattcctgctatcaagatgatccgtccgcaagcctcttacttgatctttctggattgccgcgcattgggactcaatcaggaagaactgaaccgtctttttgtagaagatgctcatctggcgctgaatgatggaacaacattcggtaaggaaggcgagggatttatgcggttgaacgttgcttgtccacgtgctacgctggaaaaagcattgaaacagttggagcaggctgtaatggatttaaaatagtcttttaagtccattccccggttcggaaataaaatcaatccgttcaggggatgaagctatatttcctgtctcactcttgctttttactatttaattttgtatctttagtgcttctcatcttcccaaagacaggtaatcatattacaaagtgaccaatatcatcttataaggtgatattggtcaccttgcaatgtgcctattgtcccattgtaacgggacgacttaccgactgcataaaaaactactaatctctgtactgaaaacccttaatctttgcactgaaaagtcttaagtacaagattgaaaaagtagtttgttgcggtatgatgatatgacaatgtctcaactatggcatcacatttaccggaatcagccgtacctcactattcaagccggagggtaatggactccaatgtccataattggccggacgatagttcaaatcaacaatattgatttctttgaatttgcgccactgcactccctgcctgtctaattctgtaattcgattcgcagggagattcgtgacttctatctcgatgtggttttttccgggttttaagaactggcccacctttagttgataaggcactgcccatgcgcatcccgcttcctgtccgttgatgcggacacgggcactttcgcgtacatctcccaaatcaagaatccagtcgtcggcctgcaaagtcggcaattcgatgtctaaggaataaacaccggttcccatgttcgtttgggctgccggatgatcgatatgggtccatgaacaggggcgatctatatcaaatgttccttgaatttccggtttgctttcggcgaagtgtaacttccaaccatgatccagacgaagactgaaaggttgctctttgacatacttccacggtttggatgcctgcaaaggttgttgatatgtttgcagaatgaacgattcaccggattttaattgcagatagacttgtgtttttccgtttgcctgtcttaccttagcttcaccacattctccggtcatgggattgaagagagcggctgcggctgcattcgttcccaatgtgatccaaccgtccactcctttattttgcaaggaagagatgaaatagtggtgtcccgtatcattcactcttcggatcgcttgtagtccgaatttggttttcatttcttcgggagaaatattgcagctggccaatgtgcgtgcataatccgttcctgtgataatcttcccctttccgattggagtaacggttgtttccgagaaagaaacagccggaagttgccggagcgtacgctggtaactttggcgtttttgttccaactgaccgtatcccggtacatctgtcggataattttcgaggaatacgatagtagctccctgtttggccagttcataaagatgtgccaatacatcactcggcattaggtgtgcagcaggcactaccaatgctttgtagcccgttccgcctgaagtaaccaactgtccgtctttgaaacgtgtactgcgaataaagttatcggaaatataatccccgtcatacccgctgttgttgatgcgatggatagcgtcgataaacttaggagccagtttatccatgtggtgtatcgtgaataataacaatcgtcccggttgctcattccacatatcatataccggaagataaatcaggaaatcattatccggccgtcccatttgcagaaagctctggcaacgggtgatatagttgaagaacgaaggggcatcacgccaaatactgtttgtcggactcatattgatagaagcgtagaacaaccatccgggccattcggcttctttcggagaatacggagtgccgtggaaaaacatgtgattgactccggaaacaaacatcaaatccatatccggtttacattgcgacagggaagtacggaaatgctccgtcagccatgtaaatgtctcggaagaagtatacgtttttcctgcaatatgagctgccgaggaggcatatttcagcatagacaggtccgaatcattctttttggtcaatgagtcctgacgcaatccttcgatgtggaactgcgacagtccgaaaccttcacattccggaatatccacggaagcatagatatcaatcagattaccgggcgaaccatgtgcctgattacgggtgatactaccgtttttgtgtgcccagtctgtccattgatgactgaagttctccaataagaggtcggaaatggtttcccggtaatccgacacgatacgtctgctaacttccggacggtttttatccaggaattcggggaaatgttcttccagtttatacccccgtctacgagcgaactgttccaggaaatcatccgtccagtcagcttgataaacttcgtatgaatcgttgaagaaagtatgtggataacttgtcttgctacttttgaaagcacggtcaaagcgggaaagataattttttaccgccttttttgagagatgattcatcacatagccttctcctcccggagctgcccgtttcactttctgccttgtttttccgatgtaaagagcgatcactttccatttgccggcaggcgctttccattgcagtttgtcttttttgacgtgagcagtcaggttgatacatttgcctttctcatcatatgccatcacccggcttagtacagaaaatggttgttgcttgggatcggtcacattaatatcctgttcaatctctttgccgccctctatttcgtatgtctggaagatagccttggtagccgcatcttctatactaacttcaggtccgccaaaaggccatccggttccggtattcatatcaatctcaatacccgtacgttttccttccgtttgtgtatgcttaagcatttccatccagcggggagaaaggaactgaatttcattcgcgtcattgccttgcaccccatagataggagtaatttctactgctcccattccggtacgtgcgtattcttccagattatacgtcagattcttttcgtctacggcacttcccagccaccaccatctggcgccgggacgtgcttccaccggagtgtccggccattgttgtgcttgcattactccacctgcggcgagcaggcaaagaactatcaattctcttttattcatcattctttcggtgtgttatagtattctatattttctgcgtcatcagttacaaaaagcggtcgtccgtccggctgttcaaagtggaagcggatgccgtcgaaggtaatgttccgtgcgtggcggatataaaaccctttggcgggaatagtgccgaacatccagggttcggggtatactttctcctgttcgggcggaatacgtttgccatcctcttcgctatatcctcctttataatagaggtgaatattccgaaaagttacgtcctcaatacatgcacccggcactccgttgatgatagaagcataccggctgtcggcattccatacattgatatcgctgataagaatacgtttcatggtacctacaggagtaccttcaggactgcgcatacgtgcgcccaaccgaaggaaaataggcgcgttgactatatttctcattgtaatattactgattacaatatcttccagatgtcctccgtctaccgtttccaatgccaatccacggcaatgttcaaagatacagttcgtaatcgcaatattgcggaaacctccactactttctgtgccgagtttgatgcgtcccgtacggaaaccatgatcgggagcctgcggttcgtccaactgccaagtgccgtccattacactgcctttgtcaaagccgctgacataacaatcactgatcgtcacattttccgtatcttggaagcgtcctaatccataagaggttttcaatacaatggcatcatcccagggggagttcaccgtgcattggctgatacgtacgttccggcagcaatcaatatcaaagccatcccggttggtgtctactttcagattcataatcgtcagatgatccactccggtagccaacagggcgaaatgcccgcaatgcagcatggataaatctttcagggtcacatttctgcaatctttcaggctgatagccttattgcctacccccggtaggcgactctcttcacgggtcaagcctttgccatagattaagccgggaccactgatcgtaatattctccagtccgattccccaaattaaagagtttttccaatggctgtgaccgaaatcctgatacttattatgttcattcggttcggcggtatcatatccttcctcttttccgggaaaggcggcaatgatacgggtgccctgttccaaatagatatgaatgttgctttttaaccggatggaataacacgcatattctcccgcaggtagatatactgtgcctcctccggcctgtgcggccgcttcaattgcacgattgatggcaggcgaatcaatcgttttcccatccgctttggctccgaagtccattacattataaatggctgcatgtagatagatgcaacctattaacagactgaataataaatagatccttttcattttttgtcgattttggcaaaaatatccggtaacatatagtagttgtaatccgctttttcattctgttcgtagaaacagaagtaaagccgagaaggcttgcttccttcgtttcgggaagaagccggggagagactgcaacgtccggccagtacagggcggtcggttcgtttgcctgattcgtaaagcatcaggggagttgcatccttatgtccgtcgctcaagcggatatcatcggtaggagtgacagcctgcagcgtccgtaattgcatactttctccgtagtagcaagtgaaggcttgtccctccacgctgaatacattgatgtccgaatccggttggcaatcgccgaaactccaaaatagggcatcggcttccggagcagaggcgacttctacttccaggataaatccacgactatcgggcagtgctttccattggaaggatactccctgtatcttttctttaggttttagccagtggctttcatttccttttgatatgcccaaccggaaagtgccggcaggtggcgtcagtgcttgtgcttgcgcatcaatgagcaagattcccagcagtacgatggtcaggagatgtcttaacatagttgaagttgatattactttgttcattctcttttagttcaatgacattcttttcttctgtctttaatgtaatttcagacaagttgaaattcttcgtatagcagattttgcccggtttgtcggtctgcgcttcgatggcataaagatagaaattttccagacgtaacgagtcattccatcccgaagcggagataaattcgtccacattttccgcttttacctttgatacgtagacattgcggaaacgcggataacctttttcgggaggcgttaccggagtcagcatgattctccagtgttccgggatttctttcccttcatactctttgggtaaagtgctgtaactgtaactggggttccagttcaagtccgccgccagcacgtgacggacgttttccgcttttacttcggtcatataaatgttttcgattgtccctccacggttcatggcgcttttcaaccgcagcacggcggaggtgccgattgcttccagattatatcccaatacattccgtatgctaccggaagtttcgcttccgcaggtgataagtccggcacctttgcgggcgatgcaattgcgtatgaccacattttccgtaggaaggttcacccgcagtccgtctgcatcccgtcccgatttgatacagatattatcatcgttacagtctacatcgcagttttcgaccaagatattgcaggaagaatcaatgtcgataccgtccgtgctcggaccgtgtccacctatattgttgttgatggtcaatccgtctatcgtgcaataatcggagtaaagaatctgacatccccaaaaaccggtacgcatcagggtaaatcctttcaatgtaatgtccgagctacgttctatgaggatgccccgtacccgtttgcagtcataatccacaatccagcgcaatccttttgcttcgtattctttccgcatttcccaatatttatcccaaaatacttttccccggcagtccagcgttccttctccgctgacggaagcgttcttttcattgacaatgttgataactgccgcgggccatgtcatctcgattcctgcaatccgtgagcggaattcgggataatgatgaatgtaagggctggccagtaaagtcacccctttgtccagttgcaggttgacaccgctttttatgaacagtgcgccagtctgataatatcccggctgaaaaactaccgttcctccaccgatgacggcacaactgtcaattgctttctggatagcttccgtgctaagcaccgtgctgtctgctactgcgccaaaagaattagcggataaaattacatggtttccgggcatttgccggctgcctacactatcggcccatgacaaatccggttgttgcggtacttgcccccattcgaagctgttgtttcctgcctgtttagccgttggggtggcgcaagctgctgtcaaaagtgtgcctgccaataggaacaggggaaagatgcttttggttttcatatttatctaatgcctgattcttaatacttaatacctactacttatctcttaatttccgtccggtttttcaatttccgtgaatggtgattcgttccagtggaaaccatttacatcgtccggctgtgccggattataggacgggtctattttcaggtgtttagccagttccggtacggctttcttcattccttcaatcacacattgggctatttgataggctccgtatggattgaagtgggtgttatcctcaaaagctttggtctgtcccggataagtgcctgccggatagtgtacgaaagcacgtttcgacgtttctgttcccaaagcttcataaagcgtacgggtcatctcgttgaggtcgatcaacggaacattttctttagctgccagccagcgcatggcttccggataatcttcgtgtgtgtcacggatatgtccggttgcgtcgaaactccggcgttgggtgggagtgaccagtacggggtatgctccccgtgcacgagcttcatcaataaatgttttcaggctggtcataaaagagtaataagctcctttgcccggtcctttttgcttttggtcgttatgcccgaattccatgaaaagataatctcctttctttatctggctcaatgcttttttcaaacgtcctgcggcaataaacgtattggctgattcgcccgattccgcataattggcgatacaaacgtccgtaccgaaaaaatgaggtatcatttgtccccagcttgcccatggctcgttgtcctggtcgactacggtactgttaccgcatagaaaaacggtaatcaccgacggatcggcaggctcgatgctgatactctggcatacgggtgcatcgccgttaaattccagcgtcagtttatcgtcccagttcagtttggctttttcgcggggtttgatacgtacggattctttttcggaaatgcgggggttgcgtttgttgatgataaatgtttcatctacgaattgtccctttttagtagcgaggttatcaatgaacagtcggcgtgattcgcctcttactgttgtcacccctgcctgtttcttgcttcccaggcgaacggttacttgatagttaccgtccggcacgcggacagaaaagaagaagggtgccttgctgcctttttcgggagtagcgacgagatcatatccatatcccgtctcctcactgtagcggggagcatctgccaactggtatgtttgggctttctcctgtgcattgacacttgccgtagctaagagtagcaagcctatgatcgtagttttcatgtaaaatgatatttaatgtatattgtttatggaatttaggcacggattacacggatttcacggtttttagaattacgcttttataaagcaacagcgtaatccgtgtaattcgtgcctgataattcccatttagttaattttcggtttgagctcgtcaggagaatctttggtataagatttcacatctcccgccactttggtgaataatgcttgtattagctccggagctatcttgtctgccggacggaaagcatccgaattcatataattcaggattgctttgtgcatctggcgggcaacgattcgtttttccggttgggaagtaatgtccatactggtcatcatcaatttaccgttcaatacctttgcttcgaacaacatgccaattttccggctgataaaccaggtatcaatactttgaaccgttggttggaatgttgccgggaagtcggtgaattgcatcacctgcgctttgttcagcagttcccaccattgcaggttgctatgatactcggtagggaattcgcggaaaagagggtgatattcattcaggaaaataccggttgtgtgcggcggacgcatcttgaaccaggaagtattccagaatacgggagtgaagtattgtttgacttctttgccgtattgtatctttccggcagccgtaatcagcacatttcctccgtcctgcaacactgccaatgctttggcgtccaaggtgtcggtggtatatactgttccttgtaccagttccacttgtgccggatatacccagaaatcccagtcgtttacggcatcacagccttcgatacgtacttccagatttagtttctgctgtgtatcgattccttccagagtcatatctacactacccagagaataaagatttccgatgggaatgtgatgggtgccgacagttccatgagcatatacttttccgaatttatccttaatggtatatactgtttttgcactttctaagggagcagctccgaaatgagatacttcaatgtcggcatggaatgtttcattgttggcatatacaaatttaggaatacgtgccaaaggtacggtcggactgcaaaagcgtctgaactgttctgcgttgatatatcctttttcttcaaagaacacgtccagtacaccgactaatgcagttccctggccggaataatcattgagagccagcaactggaatcccgcatagtccggagtacgcaaggtcttttcaatctcatgtttgtagcagagtgcctgcaatttgcccgaagccatcataaagtcgtgactctggcttcccatgtggttatcgttcagaatatcccggaagatttcaaagttcttcgctttgttgactccggtatatttacggatctcattgaaattcgggaatacgcaccattgacctgtttcgtgtgatacatacggttgtttcaccgtgtcgattcttgcacgataatccgattcactttccggttgcgcacctgcccaactaagtccgcgtgcgccggctttcacatgatactcattgtgaggttgccattgccagctgtttccaacggaggctcctgtgtatacacgacgcggatcggttgctttccaataatccacgaacttgctgacccatgccacccaacgaccggaaggttcattgccgcaagccagcatgcagtaagaagcgtaattcccatattccttggtcagtgcaatggtttcgtccatcaggtatttgtcaatcggttgtccgttacccagtctcggaccgtggttcggccagctcggtccttccggttgcagatagaaaccgaccagatcggcagcgatgaaagctgcttccggcggacagaaagagtggaagcgcatgtgattcagaccatagttacgacaaatgcggaacacccgttcccaggaagctacatccatcggcgcatagcctgtcaatgggaagtcacagttttccaccgtaccgcgaagcatcgttttgcgaccatttacatagaaccatttcccttctatcttgaaatcacgcataccgaactgtacttgttgtgtgtcagtttgcttgccgttggtcaattttgccgtcagtttataaagtgccggactgaattcatcccacgtcagaaactcttttcccatcggaagttccatttccaccggattatctcccggacggatgttgaaactttgatgtacgggagccactttgtgctgaatgtccgtgttaaagctcgcagcggaaagggtgatctctcccttggtggaagaagcagaccgtatattcatgcgaaccagcgctttctgattgcttaaatcgggatatacctgaatatcttctaaatgaactttgggagtggcttgtaattcgattcgtccgacgataccgttccagttaccttgtgtctggtcggtgatgctgtgagaatctggacctacgttgatttctttgattctattatcgatacggatggtaatcaggtacgtttttccgggggtggttgcagcagtcaggtcatagacatggggaacacaaagactgttttgcataccaagctcctgctgatttacccatacagtagtttcgatgtgcggacgttccagaaaaagagtgattctttctcctttccagtcagccggaattgtcactttcttttgataccaggccacacctacataatgtttgtcgggagtcagaaagaagggtagctttacttgtccctctatcctgtatttttccatatatgggttgaagtagtaagaactgtcgtagaggcttccggtccattgggtacggacggtcacttcatctcctttcaatttttcgggcatggagccgggtaggttgatagaatcgtcgagggattttttgaaccattgttccttgacgccggtatcttcccggtctatctggaaattccatttgccggataaactgaaagagtgattttgtcccgctacggtcagtatggagataaatacgatagcaatacttactaaaagtcgtttcatgatatatagagttgatatgtttttcattctttttaaaatctgccgctaaagtagagctttttaagggtttagtaaatagaaagatgtacagatacatagaatattgtatcaaaatggacatctaaaagcgttcgtgtacaaaactacatggatttgaaatattgtccatgctctttatctttgaggaggggcggagatgccttatctttgcaaggtaaactttttaatcttaataaggaaccatgaaaaaagtagtaatctggatagctctaagtctttggtcggtgatgacagtctttgccggtgagacagcttacctcttttcttattttatcaatgacagtaaagacggactgcatttagcatatagttatgatggattgaactggctgcctttacatggcggacgttcttatcttacccctgcggttggtaaagataaattaatgcgtgaccccagcatttgccagtcgccggacggcacttttcacatggtctggacttccagttggacggaccggattatcggatatgcctcttcacgcgatttggttcattggagtgagcaacaagcaatccctgtgatgatgcacgagccggatgcacataactgttgggctcccgaactgttttatgatgaaccttcacaaacttattatatcttttgggcaactacgattcccggccgtcacaaagaagtggctaccagtgaaagtgagaagggactgaatcatcgtatttattatgtaacaacgaaggattttcgtactttctcaaagacgaagatgttcttcaatccagatttcagtgtgattgatgccgctattgtgaaagacccgaagcgggaagacttgataatggtagtcaagaatgaaaattccaatccgccggaaaagaatttgcgtgtgacgcgtacaaagaagatagaaaaaggattcccgaccaaagtatcggcacctattacaggaaaatattgggcggaaggtccggctcctctttttgtaggtgatacgctttatgtctattttgataaataccgtgaccatcgttatggagctgttcgttctttggactatggtgaaacatgggaagatgtgtccgatcaggtcttttttccgagggggattcgtcatggaacggcgtttgcggtggatgtctccattgtggagtcactgattgccgaccggaactataatccgcttattcccgataatctggcggatccgtctgtctccaaatttggtgatacctattatctttatggcactaccgatctggattacggacttggacgtgccggaactcctgtcgtatggaaatcgaaagattttgtgaactggagtttcgaaggttcccatatcagtggattcgactggtcgaaaggatatgactacacgaatgataaaggtgaaaagaaaaagggctatttccggtattgggcgcctggaaaagtgattgagcaggacggcaagttttatttatacgttacgtttgtgaaaccggatgacaagatgggaacttatgtacttgtagctgatcgcccggatggtcctttccattttactgcgggacaggggcttttgcctcccggagaagaaggaacagatagcccggctgtcgttgatgatattgacggagaaccttttattaatgacgatggttcaggatatatcttctggcgtcgccggaatgcgggacggctttctgcggacaggcttcatctggatggtgagccggtaactctggcaacagcccgccagggatattccgaaggtccggtgatgtttaagcgtaaaggtatctattactatatttatacgttgagtggtcatcagaattatgtcaatgcttatatgatgagtcgcgagtctcctttgacgggttttgtaaagccggaggggaacgacatttttttattctcttctcctgaaaatcaagtgtggggaccgggacatggcaacatgttttatgacgagggaacggatgaatatatttttctctatctggaatacggagatggcggaactacccgtcaagtgtatgctaaccggatggaatttaatgacgatggaacgataaagacattaatccccgatatgcgtggtgtaggttatctggctgcttcccaagagacccggccgaatctggcattacagtcgcatttttatgcttccagtgagaaatctccccgtacttccgtggtcaatatcgaaacgcaacccaatcaaccgttgccggaaaaaggttcggtgaagagctatacccgcacgcatacttatcaggctacccatgtagctgacgaatcgaatggaacccgttggatggcggctgatacggatagcagtccgtttattacagtcgatttaaaggaaatccgtaaggtcggggagtgccagctctattttacccgtcccactgaaggacatacctggcgactggagaagtctatcgacggaaaacattggcagatgtgtgccgaacaagggaaagtacaagtatgctctccacatattgctaaggagataggagagacacgttatctccgtcttcatattcgtaggggagatgccggtttgtgggaatggaaaatatatgaataacgttttataacgctaataatcaatcgaatttatgaagtatatggtaaaaagtaaaattctggctactttctgtgccggtctattaaccgtttctaccggaatacaggcagcagagagactggcaaccggaactcaacagaagcaagctcaaaagactgtaattgaaacttctccctggtttgatgataaagacctgactttgacgggtgtctattattatcccgaacactgggatgagagccagtgggaacgtgacttcaagaaaatgcatgaattgggatttgaatttacccattttgccgagtttgcctgggcgcaactggaaccggaagagggacgctatgattttgcatggctggacagggctgtagctttggcagccaagtatgatttgaaagttatcatgtgtacttctactgccactcctcctgtatggatgagccggaaataccccgaaattctattgaagaatgaggatggaacgatacttgaccacggtgctcgccagcatgcttcatttgcttcgcctctttacagggaattatcatacaagatgattgaaaaactggcgcaacattatggcaatgactcccgtattatcggatggcaactcgacaacgaacctgctgtacagtttgattataatctgaaagcggagcttgctttccgtgattttctccgtgccaaatacaataatgacattcaacttttaaataatgcatggggcactgctttctggagtgaggcttattcgtcttttgatgaaataacgcttcccaagcgcgtacagatgtttatgaatcatcatcaaattttggattaccgccgttttgctgcatcacaaaccaatgatttcctgaacgaacaatgtctgttgataaagaaatatgcaaagaaccaatgggtgactacgaattatataccgaattatgatgaaggtcacatcggtggtagcccctcgcttgattttcaaagttatacccgttatatggtatatggtgataatgaggggattggtcgtcggggctaccgggtaggtaatccgttgcggatagcttgggcaaatgactttttccgtccgatacagggaacttatggggtgatggaattacagccgggacaggtgaactggggcagtatcaatccccaacctcttccgggcgcagttcgtctgtggatgtggagtgtgtttgccggtggaagtgattttatctgcacctatcgttatcgccagcctctttacggcacggaacaatatcattacggaattgtcggcacggacggagtgactgttactcccggcggaagagaatatgagacatttataaaggagattcgtgaacttcgtaaacatagctcttcccgtgaaaccaaacctgccgattaccttgcccgtcgtacagctattcttttcaatcatgaaaactcctggagcattgagcgacagaaacagaaccggacatgggatacttttgcacatattgaaaagtattaccgtaccttaaaatcattcggagcacctgtcgattttatttccgaagcaaagaacttgtccgattatccggttgttattgcaccgacttatcaattagctgataaagaactggtagacaaatggatcacttatgtaaagaacggcggaaacctcattctgacttgtcgtacggcacagaaagaccgttatggtcgtcttccggaagctccctttggttctatgattactccgctgaccggaaatgaaatgaacttttatgatttgctgcttcccgaaaatcccggtactgttgttatagacggaaaagagtatatttggaatacatggggagagattctgaatcctccggcagatgctcaagtatgggctacttataaaaacgaattctatgaaggaagtccggctgtgactttccgcaaactggggaaaggtacgattacctatgtaggagtggacagccacaatggagcattggaaaaagatatattgaaaaagctatatgtacagctgaatatcccggtaatggatttgccttatggcgtgacaatggaataccggaatgggttgggaattgtattaaactattcagatcagccttataccttcaacttatcgaagggagccaaagcattgatcgggactacagagattcctacagcgggtgtatttgtgttttcagtgaaataagtgttgaaaagaattatgttacaattaaattatttattatgagactgttgaactattgttttttgattggaggaatattaattgcttcttgtgttggtaattcgagtaataaatctcaaaatgataagaaaataaatccggcggatactatttatttaggagatttacgtgaaaaatttgaaggagattctgtcttttttgcaaaagtggcaccggatctgatattgacagattatcaatatttctgggcggcaacagagtcagatgccatagccaatgggttaacaaaagattattataagaaagtaaaacaagaaattactgccacaaatgaagcaataaagaagggagtaatgaaaggcgctaatgtgaaacgaattcccgattttcagagtgtgaaatagctaagaatgttttatcttggtatgttggataatagagtaatgatatgattaaaagatattttctaagtttaataacttgtacttgtttttatttgttggccgcttcttttacttcgaaaaatggcaactatgaagtgcttaaagtaaccgctccttttccgatgcaacctattaaagtgtttatctatcctgataaggactttataattacagacttcggtgccgtcaatggaggaagagtagataatacaaaagcaattactagtgctattgaagcgtgtaaccaatccggtggcggacgtgttgttgttccggcaggtacatggctgaccggtcccattcattttaaaagtaatgtgaatctttatttggaggagaatgcggttttgaattttacggataatccttctgattatcttccggcagtgatgacttcatgggaaggcttggaatgttataattattcgccattactctatgcttttgaatgtgagaacgtggcgattacaggtaaagggactcttcagccgaagatggatacctggaaagtatggttcaaacgtcctcagcctcatttggaagcattgaaggagttgtatacaaaagcttcgactaatatccctgtgatcgaacgtcagatggcaataggggagaaccatcttcgtccgcatttgattcatttcaatcgttgcaagaatgttttattggatgggtttaagattcgtgaaagtccgttttggaccattcatctctatatgtgtgacgggggattagtgcgtaatctcgatgtaaaagcacacggacataataatgacggtattgattttgaaatgagccgtaactttttagtggaagattgctctttcgatcagggggatgatgcagtagtgattaaagccggacgtaatcaggatgcttggcggttgaatactccttgtgaaaacatcgttatccgtaattgtcagattctaaaaggacatactttacttggtatcggaagcgaaatatcgggaggaatacggaatatttatatgcatgactgtactgctccgaattctgtgatgcgccttttctttgtgaaaaccaatcatcgcagaggtggatttatagagaatgtttatatgaagaatgtaaaggcaggaacggctcaacgtgtactcgaaatagataccgaagtgttataccaatggaaagatctggtacctacttatgaagaacgaattactcgtattgatggtatttatatggataaggtgacttgtgaatcggcagatgctatttacgaactgaaaggtaactccaaacttccggctaagaatgtaatgattagggatgtaaaagtaggagaggtaaaggagttcgtgaagaaagtgaataatgtagagaatgtagtggaaaagaatgtgacttatgataggaaagggaaatgaccctttcctgaaagtagtagaaaatttcatgctataattttagtataatgtagtatcttagcagcaaaattgaaaactttatgctaagatgaagaaatccttttatttattactgctaatcactctatatagcagtatcagctttgctcaaagcctgaaatctatatctattttaggcgattcgtattcaacatttgaaggatacctgcaacccgataccaatagcatttggtattatgtttctccgcgacagcaaacggatgtaacttccgtaaagcagacctggtggcataaattcatcaaagagaataactaccgcctttgtgtcaacaactctttttccggtgcaacgatttgtaataccggttataatcaggctgattattcggatcgttcttttattacccgtatggataagctgggatgtccggatatcatctttattttcggtgcaacgaatgattgttgggccggctcaccgcttggggattacaagtatgaagggtggaccaaggaagatttatatacattccgtccggctatggcatatctgcttgaccacatgattgatcgttatcctaatgttgaaatctactttctgctgaactctggtttaaaggaagagtttaatgaatcagtcagagctatctgcaatcactataacattgattgtattgaactgcatgatattgacaaaaagagcggtcatccttcgataaaggggatggagcagattagtgaacagattaagatgtttatgaggaagacgaagtgaaaaacaacggaaatataagaaataatattgccacttgctactctttgattaggaatactatttcaaagagtgccaagtggcaataagtttagttgtttatcttaatatcccggattctgcattgctttcttttcttcattgcttagtgcagaaccatttgaattggtgataccgtccaagaaggcttgggggatcggacgatagtaatgtttctccgatttgaattcgccaagacctctgctggcaccgtcgttgaatttatgccagcgggcgtctaacgtcttggtacgtgccagatcttcccagcgttgcaattcgccacaaagctcacgggtacgttcatttaataggaagcacatcattttgtcagcattggatgtacatcccagttcgttgtagataggagtgtcgactgtagagttataaacgtctgccacactatttaatttcatcgtagttttggtagaagcagtagtctcctgttcgatattgtttgactcataataggtgttttcttcccagtaaatagcaccttcggaggagtgaccgcctcctttcccggaacaataaggattattcttataagcttgtccaccatctacgttcttactacggtcttcaccagttttataaccggcacgttcacgtagtttgttcatccattcgacagctttgtcataattggcttcacctttacgaatatatgcttcggcaaccattagtacatcatctgccgaacgggcgatgatagcatcgcgagtaccgaattgagatgcgatggaaacacgataaccatcacggaatttagataaagctactgaacgcttgtgaggtatgatatcgtaataattacctgttttctcatttatattccagctgtgttcctgtcctttgaaatagcgtacatatgtatacgtgttacacatttttccatctttcaaaacagtatatgccggagcgttgggatatttctcatagcgattgtctcccgggtcattcacgatgtatttcataccgagttcacctccactgaaacgtttgtcaccttcttttacacctgccggagcgtatggcatatcttctgctgtccaggtgggagcacttttggtttcgttggctccataacaggtgatgaatgatttccagaaacgagagtcattgacacggtcaaatacctgcatggtatactctgtagcacttacgtatgagaattcacgtcctccggagatgtcacgtttacatccacctatatcattaccttggtatacggccggataataaagatgcatctggtttccataacgtccccatgttgattcatcattagagaattgagctgctagaatcacttcacttactttttcattggctccgttcggctgttcatagtcccaaagttctacataatcattacacaacggatgtgcgtctacaacttccgaaccatattgaataacagcatcgaggtcggatgctatataattactattccaatcgctgtacaattcggaggcacggaataaatgtgcttttgcaaggaaatgggcagcagcatatttgttaattcgtccgattgattcacctttatccggaagtagtctgtaggcttctccaaaatcagatataacctgtgtgtatatttcttcagcagaattccgtgtaaaatatgtttccgcgcttgtagacggaactaatttcaacggcacaccaccaaattgcttcactaattcgaaataagcataggctcttagaaagtgtgcttctcccaagcgtgtgttgtatgtaggtgaactttggttataatattgaggtatgttttggatcaatatgtttgcgggttcaaccagtccgtagtaattgtcccagataggttggttagcggcattttcagatgaatttaaatcttgactatagtgattccatgctggaataacattattagcatcagtaaattcatctactcccatgttgtagcactgaatcccccatatatagttgaatttgaatttcagtttctgataggctccagtcactaattcatcaagaccttcttgtgtcttaaagcggtcggtactatattgagttgttaaattctcatcaaggaaagattcactgcacgaagtgatcgagcttcctgttatgctggctattaaagcagcaaataatattctatttaatttcataatgtctttactttaatttgtttattagaatccgatgttgacacctattacaaaactcttcaaagtggtaggtgaaccaaatgttttggtattattgtcataatttaccaagtctgtatccaaaaagtcacatgctttatagatattgaatgggttcatggcttgaacatatagcttcaaattattgatacccaagttctttaattgttgtggggtaaagttataacccaatgagatattacgaactttgatgtatgagccatcctgatagttcattgcgctgttaaaggcatcggctccttcaccgttggaaccgggtgaatagtattttgcattctcatttgtaccggctacccaatagtctattttacgctgcatatagcgaccgtcaagagtaacagctccctgtggaacagtaaatccccaacgtgataaaataaagaaggatagctcaaaattcttatagctgaaagtgttactccatccacctgtccagcgtggacgtgtgtgacctacaatttttttatcgtcattggcatctattgtatcatcattatttaaatctttcactttgatttgtcccggtttacgtccgtatttggcagcttcttcggcttcttctgttttccagatgccatcatatacccagtcgtaataaacaccgatttcctcaccgacaaaccatttattgttcacatcttctgttctaccattagacaattcgtcgattctgtttctatccattgaccatgttaaagtagtgctccacgaaaaatcttttgtttgtataggtattgcatttacttgtaggtcaataccatatccggatgttttacctacattggcataagtagaaacataacccgttagtgaaggaattgacatttctagtaacaaatcatcagttttcgttttgtatgcatcgatactaccagtaagtcggttattaaagaaaccatagtcaacaccgacattgtattgtgtagttctttcccagcctagagttggattagccattttggcgggttccttctgtgaaggatctgaaggtacatagcccaaggatgactcattctgtccccagttatagtataagcctgtgatagcgcctttagttgcatatgctttgattgccgcattacctgtaacacccatacctatacgaagtttcaactgattcagccaactgatgtctttcaggaaatcttcctgatccattctccatgcgatagcagcagaagggaaacttgcccatttgtgcccttcggctaattgagaggcgccgtcccaacgcatagatgctgtcaataagtacttatctttataaccatagtttagacgaatcatataagatgccatttgagtctcggtcagacctgtgccaaaagagtttagtgtaccggcagatcctatattataccagagctcatctgatgaggctacattagtagctctcatatctcccatctcgtaatggtaggcagaagcggattgcatcaatgtcatgcctaaattatgttgacccagggctttgttataatagatcaggttatccaatgtccatgcacgtttttgttcgttcttgtattgtgcgccattgttaccatctccattaataccatctgctgcattagcgactcctaaagtgtagaattggaattcaggaccaaactgaagacgataagataagccttccagtggtttccagattttaccgaaatcaatttgcgaatacaaactggcagaagcacggaaagtgcggcgttggttggtgttgtagtctaattcacgaatagggttgatgatatttacatccccactcggataacggacatattcaccgttttcgtcataaggtactgtccacggaatcatacttcttaatgcgctatagaaatcacccgaaccggttacagacttggagaaactatatccatagtcttgagtggaataagatgcattaattgaagatcccattttgaaccaattgacaggagtcacatcaaatgaggtttttaacgtataacgttcatatgcttgccctggttgtgtacctttctgatccaaataaccgaatgaggcatagccttggaatttgtcagaccctccggatgcacttaaggtatgttcgtgagtgatccccgtctgtttaccgtgcgaagcccagtcatatgatcctactaaagatggatcgtagactccatttacccatgctttttcgatgtttttccatgaagcagttacgctaccaaatgcagctttatcggcttcataagttggagtggcagaagcataagaacctgcattgtatttggctaagcgggcataatccaaccattcggcggcagacatcatttctgtaacatcgtgtagcgtttcaaaagtgacagtaccggaatagtttagggtcactttaccttcttttccttttttggtagttacaagaatcacaccgttggcaccacgtgagccataaatagctgtggctgaagcatcttttaaaatgtcaatagcttcaatgtcggaaggattgatattttcaatgcctccattttgaattaccataccgtctaccacatacagtggaccctgttccgcattaatagagcgttgtccacgaatattaatgttgcccacctctccgggacgctgactggatgtaatatctacaccggctgttttaccttgcatcccttctagtgcatttcttacaggcattgctttcagttctttttcacctatgcgagccatagcaccggttacgtcactttttttctgtactccatagcctacaactactacttcgtctaaggtctcggtatcttcttgaagagtaattttaaagttggtatttcctgctacggatacttcttgttttttatatcctatataagtgatagtgattgtacctttggttggtacattggaaagagaaaacttgccatttaaatcagtaattgtaccattagtagtaccattaaccaacacactggcaccaataaccggttctccggtaaaatctgtaactgtgcccgaaattgtcttattctgggcataagattctactattaaaaaggagaacaaagtgagaagaaatagccgtcggatagtatccttataggcatacaggtgattacctttttggttgcttttcatactttaattattaagttataaatattggtttatagatcctttattgttgatttatctttttatcctctaatgaagactctttgtttctttttatatggatattcctgtaacgtagtactttatagaggtttagtagtataatatattgtatgatattaatatatttacatagcgtatttattatagagttaaacaaaagttagattctctttttaaacataacttttcacactctacctgtgaaaaagtgttgcaaacataacgacttaatcaagatatagcaatgcagaatcgtacaaatgcatggaaaataccgtcttttgcacgatattccatgctgtgggagcgattttcgattagttcctaaggactatgaacctttttgtttctattttattgtatggaaaatagtaatttataaacctaaaaatgatatggcgaatttttcaattgtagttgttccaactaaaaaattatcaaatggcagacatcgaataaggatagccgtagcacatcattctcaaaccagatatatatctacccaatttactttggattctgccagtcaactaaaaaatggtcgagtagtaaggcatgagaatgcagcgaatatgaatgcttgtcttcggaaactaatcaatgagtatgaagaaattattacatcgatcagctatttaccagcaatttcatgtaccgagcttatacgtataattacttatgaacaaaagaaaaaaggtataacctttcaagctgttgcaaaagaatacatgaatttcatgaaaggagaagagcgggagaaatcttataaactttataagatagcttccgaaagattagtcaaatatatgaaaggggattttcctttaattcaattgacacctatacatatccaagaatttgccaaagttcttcacgaggagaatctggcagatacaactatcagaatatatctgactttgataaaggtgatattaaattatgccggtaagatgaattatgtatcttactccattcatccttttgtcctctttaagatgccggcaagtaatgtgcgggaacttgatttgtcaatagatgaactgaagagaatacgtgatgtccggcttttaaagccttctttatccatggtgagagatatttttatgcttacctattatttaggcggtatcaacctgagagatttattagtatatgattttaaaaataagaacgatatgcgttatgtgcgtcacaaaacacgtaatagcaagaagggagaaaatgaaattgtatttactttgcagcctgaagcaaaagtgctcatagataaatatatgtcgagaaatgggcatttgcagtttggtaaatattcatcttataaacaaatatatagtttagtcttccgacatataaataaggtaacagaactttcgggggtaaagaaaaaggttacttactattccgcccgaaagacatttgcacaacacggatatgatttaggcattcaaattgaaaaaatagaatactgtatcggacacagtatgaaaaataaccgtcctatctttaattatattaagattatgcaagaacatgccgataaggtgttccgtgccgtacttgaccaattgctatagtatagatagtttttcactgctatttttagttccttcttttgctaatcgattccattccgatcgctatccttttttcgttccactatagttatccgcaaagtacactatagttacccttgcggataactatagtcaaacgcaaagataactatagtggaacgaagaaagattcgcataccggataactcataataggtaaaaaagatattaatggtactaattgttcaaatcttatcctcaattgattgctagctgtatgtagtcgtttgatgcgcaggtagttatgtttaaaaagagaatctaacttttgtttaacttaacagatataactaatgaatatggaaaacaacaaaaaaaaggcttcatttatttcaattgctggttggaaaagaatgcagccattgtcttttttactttacgacgattttactaatcaacaaaaatatgtttaactttaaaaaacatggtatgaaaaaaaactatgtcacaactgctgttgccttactacttttagcaggatgtagcaacgatattaaagaaactgatattcagtttaccggtgatacgggagcgaaagtttcttttagtgcagtaataaacaatcatgaggctagcaatcttgttacaagagctacggaaacaaactgggaggcagaagactcggtaggaatcacttgtggtacggaacaagtgaatattcattacaaatacaagggcaatggtctttttgcagcaaaaggaggaaatgcagaagaaatttgggtattaggttccggagagtatgatgtagtggcatacgctccattttctggtacatcaggtgaagaacaacctgcattagaagtgactacagctagtgaaaatcaagctacagcagaagaacgtgcgaagatagattttctttttgccaaagggaaggctacatcacaaaccccgaacgtgacattagcattcaatcatgtgatgagtcgtattagattggagtttcaagctggcgaaggtgtggacttggcagatataacttgttatcttattgggcttaagaataatggtacatttaatcctaaaacaggggagacaacagtcagtgaagaccctgttacggataaagatgatatttattgggataaaataggagagcaggataattatacagtacaagctattttactgccacagaaggtgcaaggcaaagtaactatccaagctagaatgaacggttatctttatgaagccgagtttgctaacttgacagaattgaaatcaggattttcttataattacatcatcaagacaaataaatacgaggacaataattatgtgttgacaattacagaacaaacgcaaataataggatgggaggatgaaaaccacgatcctataacatccgacccgagtatagctgaaactggaacagagataactaatcctagttggaatattacagaagaaaccgtaactccacagcctgttgtgaagtgatctgtttaccaatctaatatagataaaaatgctaaaaatataaacatgagatttatgaaaatatataattatatatcaatgctttttctggctggcgcagccatagttgcgtcttgctcgcaaaatgaagaactcaccggagaaacaccggattctttgcagggatttcagattagtgtgtctgatgaaggatttatggacgaaagtggtaagacacgtgctacagagaatggatatactacccgattttctaacggagatgctatcggtatatttgcggtaagaggagaaacggtggtagaggatatcaagaatcggaaattcacactgacagatggctattgggaattgactgatggaggggatcctattgaatacaaaggttcacaatttcagcggatgactttttatgcatactatccgtataatgcgaatgtgacttttgatccgacgaaggtggatccttttgaaacatacgtcaacaattggaaaataggcagtgaacaaaatgaaggaaattatacacaatatgatttgatgacgagtacgggtagtgttcagggggatcgtttgaaaggacagatcgcttttactatgcaacatcggatggctcttgcggtagtgaagatgcctaatttgacctatagctttacaaatggcggtatagatgattatttgttaccattaacagccggttcgtttacagtgaacaatactcaagcaactccttattatcaggaaagtacggatacataccgtttcttggttaatccgaagaaggaattctcaattaagggtacttattctggagtaagtgagatggaatatgaagctaaaggtacgctggaaggaggaacggcgaaaatgtataccatcgaagataaaagtaaaatcaaccatactttgcaggtaggagactatttttgtgcagatggaaaaatagtttcagtagatgcggaaacggtgccggagaatgtgattggtattgtatgttatgtaggaaattcacaacccagtgtaacacatactgaactctattcagcagaagttgatgctttgcgtcgcgatttccctgcatgtacgcacggtatagtgctatctattaagaattctgtggtaaaagatagtgaacaaaatgatgttgctttgaaaatgttccattcaagtaagtccggttattattcagactggtttacttcagatgagaattgggcaaacaagtttgtaggttgtaacacagagaaggatgttaacaagaatgatgcttcattggttttcccagcactaatgggatacaataatacacagttacttactatgtgttacgaaggtatgggtagtccttctacttgcgaccatgcttatgcgtatatcaaggcttatcgtgaagcggaagctattccggcaaatgtgactccttggtatttgccctctataatgtgttgggatacagtcgctaagaatttgagtgttattaaccgttgtctcaagaatgtaaatggtgatgagatgacctctgtcgagtcaggaactaacagtggacactattggagtagcacacagcgttctccagccaaccaatggacacacggtatggctggtggaagatatcacataatttgtgaacgtgattcgcgtgccggttatttccgtatgatgcttgcattctaaaataatgacggtatataaagtccgttaaaattatacttatatcatgaacatatacatatatgaataagaaaaactttataaaggggacaaccttacctgtcgctctgtttttcactatagcaacttttgcacctgcatggggattgcaaacagcttcggcagccatcgaagttgtacagcagcaaagtactataaaaggaacagtagtagatagccaaggcgaaccgataattggagcaagtgtacttgcggaaggaacatctaatggtacaattaccgatattgacggtgtatttagaataaatgtacgtcccggtgcgaaattgaaagtatcttttataggttataccgataaaaaagtagtagcgaaaaatgacatgaaagtcattctggtagaggatgtgacagcacttgaagaggtggaaatcgtagcttatggtacgcagaagaaagtgaccatgacaggagctatcgctagtgtgaagggagaagaattgacccgtgtatctgtaggttcggtttccaatgtattaggagggcagatgacaggtttgactaccgtacaatattccggtgagccgggagcggatgccgctgaaatttttattcgtggtaaagctacttgggaaaattcttcaccgttaattcaggtagacggtgtggatcgtgaaagtatgagtgatatcgacccgaatgaaattgaatccatttctatcttgaaagatgcttcggcaacagccgtatttggtattcgtggagcaaatggggtcattttgattacaactaaacgaggaaaggaaggaaaggcgaaaatttcgtttactacttctgcttctgtattgatgcctacaaaaatggtagaacaggcaagttcctatgactatgcccgttttcataatcaaatgatgtccggtgatggcaaatctgccttatttagtgatggcgtgattcaaaaatttgcagatggttccgatcctattcgtttcccaaatatacaatgggctgactatattatgaaaagctctacgcttcagagccagcataatctgaacatctcgggaggaacagataaagtacgttatttcatctctgcaggtgcttatacgcaaggaggactttttagtgagtttgatcttccttataatttaagctatcagtaccgtcggtttaactatcgtacaaacttggatatggatgtcactaaaacgactactttgtcattcaatattagtggtaatgtgaataattcagatcaaccgcgtacgagtcagggatcttccggattgattaaaaatatgtattatgctactcctttctccagtccgggaatcatagatggaaaattggtaaattcgagcgatgagacttattcagacggactgaaattaccatttacaggaggtacaggtatgggatattatggaaatgggttcagccagaccagcaacaattcgctgaatgtggatgtgattctggatcaaaaaatggacttcttgactaaaggactttcttttaaagtgaagggatcttataacagctcgtttacagttaataaagtcggttctggtgggtctattgctacatacactcctgtattgatggatgacggtagtattgcttatcgtaagtttggagagaatacagatgtgaagtattcgtatactacaggcaaagcacgtaattggtatatggaagccagctttaattataatcgtacttttggtgatcatacggtgacagccttagttttgtataatcaacagaaagagtattatccgaaattatattcggacattcctcatggatatgtcggattagtcggacgtgtcacttatgattggaagagccgctatatggcagagtttaatgtgggttataacggttcggaaaactttgcgtccgatttgcgcttttcttatttcccggctggttctataggttgggtgatgagtgaagagaagtttttccgtcctttgaagtcggtggttagcttcttgaaattacgtgccagtgtcggtttggtaggtaacgataatattggaggatcgcggtttatgtatatggctgatccatataatgtcggtttaggtgacttggcaaatcgtgtaacggcaagtggaggagcaactaacgcctggggatatggattcggaacagataatggtactgttagtctgggtgcgcgtgaggtagctaagaataaccctgctgtgacatgggaaaaagctctgaaacggaactatggtgttgatattaacttccttgatgaccgtctgaaaacaacctttgaatattataaagaacgtcgtaatgacatccttttgcgtgacggtacagctccgggaatgttagggttcattactccctattcaaatttaggaagtgtagacagttggggctgggaactttctttaaaatggaacgataagattggcgataatttccgttattgggcgggtattaacctttcttataatcagaatgagattcttgaaaagaaggaagcaccgcagaataatttatatcaatatcagaagggacaccgtatcggttcgcgtagtcaatatgttttctggcgcttctatgatgaggatacacctgcgctatatgagcagacatttaatcgtccgttccccactcacgagagtattcttcaaaatggagatgcagtatatgttgacttgaatggtgaccgtaagattgatgcaaatgatgcaagttatgactatggctttacagacgatcctgaatatatgctaggtattaatttaggattcagttggaagaatctggaaataagtactcaatggacaggggcctggaatgtaagccgtatgatttcggatgtatttcgtcagccgttctattcatcttccaatagcgagcagggaggattgttggcataccatctggatcatacatggacaccggaaaatccgtcacaatcttcggagtatccgagagctaccattgataatgcaaagaataattatgctacctccactttatatgagaaagatgccaaatacttgcgtttgaaaactcttcaggtggcatacaattttcacttcccattaatgaagaaacttggactgaatacatgtcagttggcttttgcaggatataatttgtggacgattacaccttatttgtggggtgatccggaggcaagagctactaatgcaccttcttatccattgtccaagacttatacgttgagcttgaaattaggattctaaaatagataaaggaaagatacaatgaaattacaaaataaatggttcatcggtgcgatgttgggagcggcggtttgtttggtttccacttcatgtgtggacgaaattaaattcggaaactcttttttggataaggcaccgggcggaaatgctactattgacacagtgttcaatagtgcggaatatacgcgccaatttttgaatacctgttacagtagacagtattacggattaccttataatacggacagtaacggtaatattcctgattcttccagtccttatttaggaaagaaggatgcgctaacagactgctggtcactttattttagtgacgcaactgtatatcagcagtattatttgggttctctcaatgccaactatggcacgcgtggtaatattttcccatatacacgggaaatggtatgggaagtagtgcgctggtgctggttgttaatggaaaatatagatagagtgccgggcatggatagcactgaaaaaactcagttggtggcagaagctaaatgcctgattgcggcacgctattttgatatgttccgtcattatggaggtcttccattgttatatgcttcattcaccggtacggagtcaggttatgaaatcccccgtgctacggtagaggagactgttaactacatgataaagatgttggatgatgctatcaattccggtggattggtgtgggcttatgctgatgccgatcttgccagcaaggccggacactggacaaaggccggtgcgatggcattgaaatgcaaaatctggcaatttgccgcttctccgttgtttaacgatgtcaacggatatgcaggaggaaactcagaggctgaacagcagcatctggtatggtacggcggctaccatgcggaactttgggataactgtttgaaggcttgtgaagcattctttaaagagctggagagtcaaggcggatatagcctgaataaggcttcggaagaaacaccggaacagtatcggcaggcatatcgtatgggatatattcgtcagaacagcaaggaggtcttgcattctgtccgcacgaatatgtcggacgctttcaactcaagttcttatatgtggcattcctgggctgttccgtcactttgtcgtaccgaatatccgcctacacaggaatatgtggagatgttcccatgggccgacggtactccgtttgactggaaaaagacggaaacagaaggtaagttggatgcaatgttcctgaccggaacattcaaaaatggagaacaactattgtcggaaatcgtattaacccgtgatcctcgtctgtatgagcattgcatggtaaacggattgccgaagatgttagactggagtgcaggaacaatgtccggtttaccttatgaattgtgggtcggaggatacgatgaaggacaaaatgctgcacttgaatcaggtaactatgcgactggttataaaaatatgaaatattatttgggaacagagtaccaacgtcagtatacgcattgggtatatcttcgtttatctgacatttatttaacttatgcagaggccttgcttcaagccaagaatgatcaccggggtgctattgaccaaatgaatatagtacgtgcccgcgtaggattgaagaaagatttggcggagtgtgttacagataagaatttactttctgacaaagcagccttattggaagaattgctgtgcgagcgtgttcgggaattggggcttgaagatagccgttactttgatcttgtccgttacaagcgtgccgatcgtttcgagaagcgcctgcacgggttgctcgcctatcgtttggatgataccggtaatcgtataacgggaaatgctaaatggaatgaaggagataagaacaagggggcattgcagcctactcgttttgaatatgaaaggtttgagttatccaagccggtccgtcggtggtggacatacggatttgatcccaaatggtatctttctccattcccgcaaacggaaattaacaaaggatatggattgattcagaatccgggttggtaatgtgagacagcgaaatagattaaaacaatattgaatattgatttatatgagaaaaaataagattctgatactggctttactggtttgtttgagcattccggtcagagcacagaatacagacaacaacattataggtattgttgttgataaatcgggaaacccagtctatggagcgtccgttaatgtggaaggtggcgcagtggagacccgggttgaaactgataaagatggtaaattcgagattgcggtcgagaaaggacaacgtttgagtgtcgtttctgtcgacaaaggctctaccacagttgtggcaaagactgatggtccgatgactattgtgatgggatatgcagctcagactattgatgtgggagctaaccggacattcagtcgtcatgaatcaacagcagctgtttctaccacctataacgaagagtttaataagcggtcttcccggaatatatccaattctttatatggatatggattgggccttactactttgcagaatgcggccagtaccgggttaatggcagatcctaccttttatgtacgtggtttgcagagcttgtcaagtagtacaccgcttgtgctggttgacggtttggaacgagacatgagcttggtgagcccagaagaagtagaatccgtttccatcctgaaagatgccgcggctgtggcattgtacggatacaaaggggtgaacggtgcgatcttgattactacaaagcgtggtaagtacaaaacaaaagagataacttttacgtatgatcatatcattaacactcagtctcgacgtccggaatttgtagatgcagctacgtatgcttctgcagtgaatgaagcgcgtggatatgaaggtttgggagctcggtatactccggaagaagtcgatgctttccgtaatggagtaggtagtggaggggcttcccgtatgtacccttatctctatcctaatgtgaactggattgatgaaacctttaaagacagaggagtttctaataaatatacgatcgaattccgtgggggaggagcaaagttccgctactatactatggcgaatttattaacagacaaagggtttatcaaaaccccgaatgcaaatgacggatattctacacagaatatgtattcacgtgctaatttgcgtacaaatctggatattgatttaaccgccactaccaaattgaagttgaatcttctcggtaccttgtccgaatctcggattccgggggcttcggttaacctatgggatatgatttattcgattccttctgcagcttttccggttcgtacggaagatgacagttggggaggaagtactacttgggcgggaacatcgaatcctgtcgcacaatcgcagggagctgcttattctaaaggacactctcgcagtttgtttgccaaccttaccttgtcacaagatttatctggtttgctgaaaggattgggagcaaactttcgtttagcttatgacaactattccaatattctggaagaccatagcaagacttatacgtatgccggttatgcaacaagctggacaactaacggtccgttttatactgccatttcaggtggcgaatccagtgaaatgggttcgggtgcaggtattgacaactgggcgcgccaatttaactttgcaggtagtgtcgattacaatcgctcgtttcggaagtgggatgtgtattctcaattcaaatgggattatgagtatcgtgattcatacggattgaacactactatttatcggcaaaatgtatcctggtataatcatgtaggtttctctaatcgctattatttggatctggcattggttggctcggcctccagtttattggcaccggggcataaatgggctttctcgcctaccatttctgctgcttgggtgctttcggaagaaaaatggttgaaagatgtgtcttgggtgaacttcctgaaattgcgcgcttcgtttggagtgatcaatgttgattatctgcctaaagacggaagtactaccgtatatgactattgggatcagatttatacgactaccggtacgcaatataagtttaacagtagttacgactctgaattcggaagtactattatcgggcgcctggcaactgctaattcgacacatgagaaagcgtataaatacaatgttggtgttgatgccgtgttgttcaatggactggacgtgacggcagaaggctattaccaacggagaaaagatatttgggtctcttccgaaggaaaatataccgatgtgttgggcgtagatgctccgttcgagaatgccggaatcgttgatagctatggcgtggaactaggacttaactatacgaaacggttaggagatgtagtgttcaaccttggcggtaattttgcttggaataagaatgaaattaaggaacaactggaagaaccgcgtttgtataagaatcttgtgcaaacaggaaatcggttgggacaagtatatggaatggtagctgaaggtttcttcaaagataaagaagatatagcaaacagccttccgcaaaactttagtacggtagtgccgggagacataaaatataaagatgtgaatggagacggaatcattgatgccaatgataaaacagctatcggttatagtacgacggctccggaaatttattattctttccatttgggagccgaatggaaagggattggagtagatgtaatgtttcagggaacaggtaactattctgctgtcttgaatacgaagagtatgttttggccgttgataaataatacgacactttctactcattattatgagaatcgttggacaccggaaaatcaaaatgccaaatatcctcgtttgagttcacagagtaatgccaataactatcaggctaatacagtttggttggcggaccggtcattcttgaagttacgtaacgcggaggtgtattacagatttccggaagaatggatgaagaagactaagatattggggagtgccaagttatatgtcagaggaacagacttgttctgttcagatcatattgatgtgacagatccggaatgttatggtgtagcgactccgctgaataagagtgtagtagtcggtgttacgattggtttttaatcataaaaacaaagcgaaagaatgaaactgaaaaacattatctacggaatgatgtgtgtagccgcactcggttcctgctcagataagatggaatatcatgagtacaataattatgatgaggattttgtgaagctcaacttcggtaatgtaggagggctgataacaaatatctatttgtccatggatgtggactttggaaactatagcggggcaattcttggttctgctaccgatgagtccgaatatgcttattcgggaaatcagattgaagacttttacaatggttcttggagtccgtcgaatgctaaaagtagcatgtggacgtcctgttatgaagggatagccaattgtaatttatatctggagaagtttaccggactgacatttcccgagttggctttgaacagtgattatgcacaacagatgttccgctataccaattaccagtatgaggtacgtttccttcgtgcatatttctactttaacttggtacggcaatatggagatgtgccgtttagcgaccatatattaacagccgaagaatcgaatacgttatcgcgcagaccggcacaggagatttttgattatatcatagccgaatgtgatgatattaaagataagattatcgtcgattacagtaaactgggagatatggcattgcctagtagtccggcggaaacaggacgtgccaaccgtaaaacggtattggccttgaaagctcgtgcagcattgtatgcggcaagtcctttatttaatccgactgataatagagaactgtggtatcgtgcagctaaagccaataaggaaattttagatgacagtaatgggtttgctgaaaaggcaaaactcttagtggaggattattcatcactttggagcaaggacaattacaatgacgctactaatgaattgatttttctccgtcgtgccactactaccactaattcttttgagggatataacttcccggtagggttggaaaattgtaaaggtggaaactgtcccacacagacactggtggatgcgtatgagatgaaggatacagggttgcgtccggacgagttggataactatgatcctgctaatccttattataccaaccgcgaccctcgtttctatctgactattgccaagaatggggacgaaaagtggcctaactggaatactgttcctctgcaaacctatcagggcggactaaatgcggagcctttgagtggcggaactccgactggctattatctgaagaagtattgtcagacggcagtagacttacgtgccggtacagcttcaaagacctatcattcatggattacattccgttttggagagttctatttgaattatgcggaagctgtatataagtatctgggtagtccgtatgcaacggataatgaatttacaacttcggctgtggatgctatcaaagtagttcgtacgcgtgccgagatgcccggattccctcaagggatgaccaatgatgctttctggaagaaatatcagaatgaacgtatggtagaattggcctttgaaggacatcgtttttgggatgtacgtcgttggaaggagggtgacaaacatttcaagaacattgttgaaatgaagattacgaagaatggggatgatacttatacgtatgaacgtaaggtaaaagaaagaagttgggatgataagatgtatttcttcccgattccgcagagtgaaaaatctaagaatcctaatttggagcagaatccggggtggtaacccacaaccggaatgctgatgaatagtgataggatattcttgcatagaacggatgtttatagaataaaaaaacgaaagaaatgaagaaacattatataatactggggctgttttgtctgctggccatagttgcctgctcggataatgaccccgtcgttgaagtgaacaatggcaatcagacggaagaggagttgccgcctctgcctactgaagttataacgggtagccgtgcaatgtgggttagttacgacccggcaccaaatgttgacgccaataactcttccggcatatcatccgcattgattagctggagattactgaagaccgatccgtctaatgttgcttttgatatttataagtcggtagacggcgagacggaagtgaaattgaatgagaaacctatttcgaatactacttcttgggtggatgcggatattgatgtatcaaaaacgaatgtataccgggtcactcttgccaatcaggctgaaacgctttgcgattatacctttacctctgaaatggcagaaaagttttatcatgagattagattaaacatgaatgtacccgatgcgtcgattacatattctcctgatgatattcagctaggtgacttggacggtgacggtgaattggagattgtggtgaagagagaaccgtatgatggtgccaaccaggggggatggaataatggttcgaccttgttggaagcttataagatggatggtacttttttgtggcaaattgatttgggaatcaatattcgttccggttcacattatacttcatatattttatacgattttgatggagatggtttatgtgaaatagctttccgctcttcagaaggtacaaagtttggggatggtaagggcattaccgatgcttatggtaatgtgaacgattatcgaattcgtcagactgacgctgtgggctggtattcgggagcaagtattaatacaatttgcggtttgataatggaaggtcccgaatatatctctatttgccgtggatatgatggacgtgaaattacccgggtggataatattcctcgtggtggaagtggttcaaaagcgtcgcgtgctaaatattggagtgaatattggggagatgattacggaaaccgcatggaccgtttctttatcggggtggcttatctggatggtatacctgacgaagcgaccggagtgagaacaagcaaccccagtctgatcatcagtagaggtatttatcataattggcaagtatgggcactcgatttgaaagggaataaactggaaacccgttggaagtttgatacagccgaacattcttcaaaatggttgtccatgtgttcgcatagttttcgtgtagcggacttggacgatgatggaaaagatgaaatcttgtatggttctgcggctatagatgatgatggaagcgaattgtggtgtaccggaaacggtcatggtgactgtttatgtgttggcaaatttataaaagaccgttcaggattgcaaattgttgcttcatttgaagaaccgggcaattataatggacaaggacacggttatggatgtcaagtgattgatgcaagagatggtggcttgattaccggccatggagcgggttcgactactgatgtcggtcgttgtattgtggcagatatcgatccggatagcccgaattttgagtactggtcttctttgcaggaaggggtattcagttgtagtggcagtggattggtatccagtacatatcctacaggtattggtggtggagttttgtataatgtagccatttattggagcgggcagccgacaagagaaatgctggaccgtgcttgtgtcgtgagctataaagagaaccctgatgtaaacaagacgaataagactcgtttggtatattttggaacttacggtagcaatgacggtaaccatagcaccaaatacaatccttgttactatggtgattttctcggtgactatcgtgaagaagtaataatgggttcaagtgacatgaaatctatttatatattctccacgaatcatcctaccgaattccgtcttcctcacttgatgaccgatcataattatgatatgtctcaagcgatgcagaatatgggatataaccagggaactaacttaggttactatgtaggtgctgaaactttgaaaaaagcagaataaaaaggtttttgaataagaaatctcttatttgatatgagtttgttgaaaaagaacaatccggctaactgtcgggttgttctttttttcatagttgaacgaatcgccatatatatggataatattctatttcttaattgatcggctctccctacctttgtaaggtgagatagcaaatatacatatgaaaaaactctttatccttttgttcctcttcatcactttaggaacaaacgcacaaaacaataaagtttccggcctcaacgcccgccagtttcataaatattggaaggtagagtcggaatctccggattataaagtgacatttcagggtgataccgctgaaatactatctcctaaaggccttaccttatggaggaaagaaaagatgagcgggcgggtaaccattgaatatgatgcgtgtgtagttgtagaaaaagaaggagaccgtttgagtgacctgaattgcttttggatggcttcggaccccaagcatcctgataatatatggaaacgtgagaagtggcgtagcggaatctttctgaattgttattctttgcaactctattacatgggatatggtggaaattataactctactacacgcttccgtcgttatgacggcaatgaagcaggaatcacagatcccaaagtacgtcctgccatattgaaagaatatacagataccgaacatttgctaaaagcgaatcactggtatcacattaagataacaaatgaaaataatagggttagttattacatagacggcaagcgactggtggacttccgcgatgccgaacctctgacagaaggatggttcggctttcgtaccaccttatcccgtacccgcattacaaacttccgctatgaatgtttgccgccccaaacgtctactgttcctttacattggatcggcaatactcctgaacaagacaaagctgtaagcttcggagttccttttgatgaaggctacctatttccagaaacttcattgcggttaaaaacagatagaaatcaagagattccggtagatacttggccattggcttactggccggatggttccgtgaaatggagcggagttgccggagtcattcctgccggaacagaaagactgacattagaaaaagccccccggaaagcaaaaactatcaataaacagcctaatacttctattgcaatcactgaaacgcctgaagatattcaaattgaaacagggctaatttccgtatttattccccgacgcggagatttcctgattgatagcctattatataagggaactaaagtaggagagaaagcgcgtctgatttgtaatacgcaaaacgagccgattcaagaaaatacatctcaaatatcttttactcattacataggagaaataaaatcagtaaccatagaacgtctgggctctgtacgggcacttgtaaagttggaagggatacatcggaacaggaataagaagattgatacgaatcactctgaaggggaagggaactatgcgaataactctgatatgaacaaacggaataaccgtgagtggcttccttttgtggtacgtctctacttttatggtggtagtgaacagatcaaaatggtacatagcttcatctatgacggagatcagaagaaagatttcattcgtagtttgggtatccgtttcgatgttcctatgcgtgaagctctgtataatcgtcatattgctttttcgtgtgcagatggaggagtgtggagcgagccggtacaaccattggtagggcgtcgcatactcactttaaataagacagataataagaaaaacagtaatgaaaagaaagatgcacaacagatgccgactgatgaaccctccctgcaacagcagcaaatggaaggcaaacgtattccgccttatgaatctttcgatgaaaagaaccgctctctgctcgataactgggcttcatggaatgactaccgtctgtctcaactcactgccgatgctttctccattcgtaaacgtgccaataacgataatccctggataggaaccttttccggcacacgtagcgatggatatatttttgtcggagatattaccggaggattaggactttgtatgcatgacttttggcagtcttatccctcttctattgaaatttcagacgcacgaaccccggtagctacccttaccgcctggttgtgtagcccggagtccgaacctatggatttacggcattatgataatgtagcccatgacctgaatgccagttatgaagatgttcaggaaggcatgagcacgccatacggtattgcccgtacaactactctcacacttattccgcaaggcggttataccgggaaaaggacttttgctgattgcgccaaacaattttctaaccctagtctgttaatgccaaccccgaattatcttcatgcccgccaagctttcgggatatggagtctccctgaccgtactactccattacgtagtcgtgtagaagaccgcttggatgcttacattgacttctatcagaaagcaatcgaacaaaacaagtggtacggtttctggaattatggtgatgtgatgcacgcttatgaccccgttcgtcatacctggcgttacgatgtcggaggatttgcctgggacaatacggaactggcttctaatatgtggctatggtataatttcctgcgtaccgggcgtatggatatttggcgtatggcagaagctatgacgcgtcatacaggcgaagtggatgtctatcatatcggtcccaatgccggattaggcagtcggcataatgtaagtcattggggatgcagagcaaaagaagcgcgaatcagccaggccgcctggaaccgtttctactattaccttactacggacgaacgttgcggtgatttaatgactgaagtgaaggatgccgaccacaaactctatgacttggaccctatgcgcctggcccaaccccggagtgaatatccttgtactgctcccgcccgtttgcgtatcggtcctgactggctggcttatgccggtaattggatgacagaatgggagcgcacaggtaacacaacttatcgtgataaaataatagcaggaatgaaaagcattgccgccctgcctaaccgcctttttaccggccccaaagctctaggatttgatccgtcaacaggaatcatcacaaccgaatgtgaccccaaattggaaacaaccaaccatttaatgacgattatgggtggatttgagatagccaatgaaatgatgcgtatgattgatatacccgaatggaaaaacgcctggcttgatcatgctgcacgttacaagaagaaagcatgggaacttagccatagccgttttcgtgtctcccgtctgatggcttacgcagcttatcacttgcgcaatacccaaatggctgaagaagcctggaaagatttgtttacccggttggaacatacacctgcaccgcctttccgcatcactaccatacttccgccggaagtaccgtctccattagatgaatgtacgagcattagcacgaatgatgctgctctttggagcttggatgctatttatatgcaggaagttattccgaaggatgaatagcagaagcatttatttcttcacatttcaccatatcccaaccttggaactgaattaataataggtgaagtgtcgttccagtagccagtttctgcacaactttatccttactgtatcgcaacagttgctgtcttccttcttctgcttgggcttcaagttcagcattggtagctgtacgtgtagcgtatttcaactccaggatatagctgtgttctatatcggaataacgcattttgtccggcaataggaagaagtcacaatagccatagttcatttccagttccggctgtacgagataataagaagcaatggcaagataggcttttaggaaaccttgcaggtttctttccccttctatcgcatcacgtatggaagagttctcccgataggcacgggcgatggtttcgaagaatggttgccaatgaccatcgaaggcgaaatcatctatcaagtctttcagatgtgaaagattcagggtatgggcctgttgatagtagtcgcgcaagaatccaaggtactgctcgcgcacacaattgttaggtatgcacattttcagacggtcgccacgggtgccgcacatggtaagtaaaccataataatagagcaggcttcggaagttctctatatctgctatcttttctgacgggaacgaagtatgtaagtctaccagtatttcaccttttgccgcaatttcttcgatagtactcatgcggcttccctcatgggtgttgtcgtggtcaatgcgtgccagcattttcagtttactgtaatccgtacggatattcttgtctaccatattttcgggtggacggtgaaaatcaatttggttacgtaaatagtataaagtcatatcgcaattaaacacacggtcgttgtccaaagatgttctggcgaagcaataattgtcataccacggtttcatttctgtaatcatcgcttctacatcaccgaccagctttccattttgttggtaataacggagcatttcacgtacttcagtttcatcaaatcctatcatggcattaaaacgggaatcagtcgatatattccagtcaatattatacccgctagataaatcatccagtgtgatagggctgactcccattaggaaaattcggtcaaacatacctttgaactgcttgaagtattcacggtagaagccgctggcatgagtcaggtcatggaacattttctgtccgtgttcgctcaatatgacgttggtaaagttgtcatattcgtcaattatcagatagagaggatatcctttttctttagcctttacttctatatatgataattttgctttagcgctttcaatgctttctactgttgacttgaaatcttcatcataataagatgcgtatgcatgggcaaactggttgatgatgatactgcaatattcattaaagctactcatcaaatctgctcccggcagtgagcagcctgcttttgagaagtcgaagaaaaggacttggaaactgttatgttgtttggttggacggcttcctatccataagtcaccgaaatacttgtcgaagttatccttctgtattatgtcgtaataagtacgcatcatgcttaggaataagctttttccgaaacgtctcggacgaataaggaaaaggtaactgggcatttcctcgataaggggcagatacatggttttatcgacgaaatagaagttttcgttccgcatccggttgaagtcggatattccgtatggtattcctttcacttggctcatattggcaggcttttaatttgtacaggcaaagttaatctattccgtggaataaatcaatgatttgcgactgtattatgttggatacgaacattcatttttcccttgaatggggatgaacatatcctgtccagatgttctgtttttaagattatattagaaaataaccgttgcgaaattgatgaatcagagaaaaaactgcataaataagtgcaataatatgcagaaatataggcgaaaagtgaataatatcagacagaatatgcgtcttttctaacggaaaaagagttcgttaggtttaaaccaacagggtgatcctcaccgatgaacgctatcttcctcaccgatgaacttgtccttcatcggtgaggaagatataaatgtgcttttttaagctagtttttctctgatttacctggacttttgaataagaaaataataacataatggaagattaatccctgaatcgatatcgacttgcaagtgttgtaggataaaataggtgtgaaatgctagataaactctataaatgataagaatgaggatttgcgtgttgacaaatgtcggagcttttttattcttcttcatctgctatgctgttttctccattctgcactgcttaaatattccttttttaagatagaatatttaaacagtccggatagtctatatttccctttagtcctttgctatctttacaggattctctttcgtattatttcaaatactcttttaatggacaatcggtctttttcaaccctttagcaatgcttttcgcattcatgtgcgctcctttcaaggaagtgtgcgtatgatcatgattatagtaggtaatcgctttcttgataccaaccttttccaatttatcggcactaattttatttaaatcaatgaaataagccccggtagcttcagctgcttcacgtgtccatttaccgaaagactctgtgttgcgttctatctttccctctttccatttgttgcgtggagtatggcttaaaacgatgggaatggcgcctttctcctgaacgtccatgatgaacttccgaagataccagccaaacgtataaataacctgatacttactggtcttttccattaaaaatactttgctctcgtcaccggaaccacgtaattcggcacgggcctttcctacattaatatctcctgcatcattatgtccgaactgaatcagaacgaagtctcccggttgcaaagcattatataccttatcccaacgaccttcgtccaggaaagtgcgggcactgcgtcctgccatggcacggttttctacagatattttattcagattgaactcgtcggcgattacgcttccccaaccccacataccatttttgtctttatcctcatttcggaccgtactgtctccgatggtaaacaataccggacgtccatctttacggctggaacctgttacagtatctttctcaatgggctttagataattggccaattccagtccctcataagcacgtattccatccgcagcagattccgcattgactttagcaccgaaagcacttgtgtgtatacggtcgatgtagaacatatatttcaccttattcttaccgaacttctcgaatttgcgggcactgatatcattcaaatcaataaaaggaaccccctgttcttcggctacttgctttgcccacaatccgaaagtcttgttgacacgtgtgatgatggtgctgtctttatcttcccaggcattgcggggagtaagcgagaataggatcggatgagcaccttttgcttttacatcctgaataaaacggcgcatatattccccgtatgtatatacggtttctttcactccggtctctttgatggttacgttcagcgtatctttgccgattcccggaatagaggcgcgggcacgtccgctgtcataaggaccattgtcattgtgtcccaattcgatgataacccagtctccggggcgtacacctttgattacatccggccaaagacggttgtagaaagtacggctgctggtacctcccaacgcatgattctcaacagtaatccggttggaatcgaaatattcaccagcaaaatagccccatccccattgtccgttgttgccattgcctaaagttccggtacgcatggtcgaattacctaccagaaacagaacagggttgtcacctttccggctggaaccggcttccggtcgcgaggtacgtgctttattcaggctatccagcgtgttgtcaaccacctgattgacatctgccatgggagcggaaactttattttgcgcttgcagttgcaaactgaacgtaatggctgtcagccaacatatatacgggaataatttgtttttcatgaatctgttttctttgaaatccctcactgaccggtgtctaaacagtcagtgagggaactagctactaactaacctctaactaaacctaatgaatgattatctttaaacctaatgaaaaaactgtgtatgttattttaatttataaacttctgttccggcaagcaggaaacaaccgactccgtagtcttcaaagtcgggcacactcttataagtaaccggctgtccgtctttaggctctttgcctgttccctgcacatatcccaggaatccgttcggatgtacggcatctttcaccatagcgttccatgcttttaaaaggacgggaagatactctttacggtcgagcaatccgttgcggactccccaagccataccataaacaaataaggctgtaccggaagtctcttttcctccgaagttcgtcgggtcgtgaagactgacattccagaaaccatcttcacgctgacatttcttcaaagccttgctcatggtcaggaaatcattgatatagtcctgacggtgtttctcatcagaaggaatctcatccaatacacgtaccaaggcagcatatacccatccgtttccacgactccaatagcaatcttcgccattcggctctttatatggaggattaaaatcctgatcgcgccaccacaggccgtctttggggttgaacatacccgttttatcgtgttggctgcgtgtgtagtagtacatatcccacatcttatcgtagtatttctgttctccggtcatctttccgaatttagcgaagataggcattgccatttgcacagcatcaatccaccaccagtcgttcacctgcggggtgttcaccaccatatcgatacttgctttgatattccgaatcatgttcgggtctgacgggcagattttatagatatcaatgtacgcctgtccgcaacaatggtcgtccgcattacgggtagtattgccgttgcgcattccccatttgtggaaatcggcccagtcgtaagtatacttataataatcctcacgcggataaatagaatagagagccatcaatccttcataatatacaccacgcgtccatatattgctgggacgtacacgaccgtaaaaactgggagtagtgtaatcggcatactttttcataaagtagtcattaacctttatgatattctctaaagtctctttttgtgtcgggagttcttgtgctgcgaccgtatggactggtatcagacaagaaagaagcaatcctgtaaagagtaagaatagtggtttcttcatggtacaatagttctgttttattaatttgctgtttatactaatttctatggcaaaggtaagagacgttcttttctttttcaatggatttccgtgcaaatgtctttaaattcgttcacgagacgacagaaaatagtgttaaaagtacgtctaatgatgatttctacatatatctgtacaatattctattttatcaatgggctgcgtcctttacttttgtgttgtaatttgattaatcgataaaactatgaagtgcataactcttttttttagtttctgcctgatagctatcttctcgatagcccagccaaactatgacttttcgaagttgaaacgcgaacgtctgggacgtggtgtaattgctatccgagagaatccgtctactgtggctgtttcctggcgttatttgtcttccgacccgatgaatgaatcttttgatatttataggaacgatgaaaagataaacaaacacccgttgaaggatgccactttctttcaggatgcctatgcagggacagaatctgtactttataccgtgaaagcaagggaaggtaaaacggaaagtagctatcaattaccggcaaatgccccattgggttatctgaatattccgttgaaccgccccgaagatggtacgactccgtcagggcaaaactatttttatgctccgaatgatgccagtatcggtgacgtggacggtgatggcgaatatgagattattctgaaatgggacccgagtaatgcacatgataattcacatgacggctatacgggagaagtatatgttgattgctataagttgagcggaaaactattatggcgtattaatctgggacgtaacatacgtgccggtgcacactacacccagtttatggtgttcgatttcgatggtgacggcaaagcggaagtagtgatgaagaccgcggacggaacggtggatggaacaggaaaagtgattggggatgcgcaggctgactatcggaatgaacaaggacgtatcctgaccggaccggaatatctgacagtttttaacggattgacaggagaagcgatgcaaacaattgattatgtgcccgtaagaggagacttgatgggttggggagacagtcgtggtaatcgcagcgaccgttttctggcctgcgttgcctatctcgacggcatacacccaagcgtagtgatgtgtcgtggatattatacacgtactgttttggctgcttttgactgggatggaaaggagctgaaacaacgttgggtattcgacagtaataatcccggttgtaaagattatgccggacaaggaaaccataacctgcgggtaggtgacgtggacggtgacggatgcgatgagatcatctacggttcatgcgccatagaccataacggtaaaggactctacaccacgaaaatgggacacggcgatgccattcatctgactcatttcgacccctctcgtaaagggctgcaagtatgggattgtcatgaaaataaacgtgatggttctacctatcgggatgcagctaccggagaagttctatttcagattaaagacaatacagatgtagggcgttgtatggcagctgatattgacccgactcaaccgggcgttgaaatgtggtctgttgcttccggaggaataaggaatgtgaaaggagaggtggtaaaagaccgggtaagaggtttatcctgtaatatggctgtttggtgggatggagatttgttgcgtgaattgttggatagaaatatggtcagcaaatataattgggaaaaaggagtgtgtgagcgcatagccatttttgagggaactctttccaataatggaaccaaagcgaatccttgccttcagggagatatcgtaggtgactggcgcgaagaaatactgatgcgtacagctgataatacagctttacggctttacgtctccactattcctaccgactatcgttttcatactttcctcgaagatccgatttatcgtataagtatcgctacccagaatgtggcttataatcagcctacacagcccggattctatttcggaccggagcttcagggcactgtattcagaggatgtaaaatacctaaaaaatagattatgaatattcgtatcataaccattgctttattgctggcaactttgccggttagtgcacagaaaaagaaaacggtagtgaatgattcaaatactcctttgcatttgctgcaacctgcttatcagggcacttatggtgacctgacacccgggcaggtcaagaaagatatagatcgtgtatttgcttatattgataaggagactccggcacgcgtggtagataagaacacaggtaaactgattaccgactacaccacgatgggagaggaagcgcaactggaacgtggtgctttccgtctggcaagttacgaatggggagtaacctattcagccttgatagcagctgccgaagccacgggcgatcaacgttacatggactatgtgcagaaccgtttccgctttctggcggaagtggcgcctcattttaaacgtgtgtacgaagagaaaggtacaacagaccctcaactgctgcaaatcctcactcctcatgccctggatgatgccggggctgtgtgtgcagcgatggtgaaagtccgtgtgaaagaccgctcacttcctgtagacggattaattgagaactattttgattttattcagaataaagaataccggttggcagatggtacttttgcccgcaatcgtccgcaacataatacactttggctggatgatatgtttatgggtattccggcagtagcacaaatgagttattatgacaaggagcaaaaagataaatatctggcagaagcggtgagacaattcctgcaatttgccgaccgaatgtttatccctgaaaaaggattgtatcgtcatggatgggtagaaagcagtaccgatcatcctgccttttgttgggcgcgtgccaatgggtgggctatgctgacagcatgcgaattgctcgatgtattgccggaagattacccccaacgtgcgaaagtgatggattatttccgggctcatgtacgcggagtgactgccttgcaaagtggagaagggctttggcatcaattgctcgaccggaatgattcttatctggagacgtctgctacggctatttacgtatactgtttggcgcatgctatcaataaaggctggattgatgccattgcttatggacctgtcgctcatttgggatggcatgccgtggccggtaagatcaatgcggaaggtcaggtggaaggcacttgtgtgggtacggggatggctttcgatcctgctttttattactatcgtccggtcaatgtatatgcggcacatggatacggaccagtgctttgggcaggtgcggaaatgatctctctattgaagaatcagtacccgcagatgaatgacagtgccgttcagtattatcaggtgaaacagaagacgactgcacctatttttgccatcgatacagaagaaaagaaagattaactttaaatagatagaaccatgaaacgagaagcttttaaaatgtatttaaaacccggatgtgaagctgaatatgagaaaagacacgctgccatctggcctgaattgaaagcattgctttccaaaaacggagtgtcggactattcgatttattgggataaggagaccaatatcctgtttgctttccagaaaacggaaggtgaggccggttcgcaggacttgggtaatacggagattgtgcagaaatggtgggactatatggcggatatcatggaagtgaatccggacaactcaccggtgtccattcctttgccggaagtattccacatggattgattttttagtaattaggtgagccgtttctttcattatctcaactatcttgactatttttgtccaacatttattattaatcttggaatctatatgatgcaaagacaccttttgatctttacctttcttgttagttttgtgttgaatgcttatagtgcaattgagcttcgttctacacaaatgagaacgagtgacggccttcccaataactctattcgatatatttatcaggatagtaaaggttttttgtggctggctaccttgaacgggttaagtcgttatgatggcaactcttttctcactttccgtccggaaatcggtgatgaggtatctttggcagacaaccgtatttacgatctgacagaagataaagatggttttttgtggatttctactacacctgaattatatagttgctatgatttgcaacgtgcccgttttgtggactataccggttgtggcgagttaaggcagaattattcaacggtttttgtcgctgctaacggagatgtctggctttcccattcgggaaatggctgccggaagatggtacatcagaaaaatggtgagatgacatctaccgtattcaggaccgaacgtggaaatctgccggataaccgggtgaaatttgtgaatgaggatgccagtggccgtatctggatcggcactcaatgcggactggtttctgtctccaacggacaatatcggatagaagaccgattaatccacttcacttcttcgctgtcctataaggacgatatgtatttccttacagcagatggagatatctattattatcaggaggctactcaaaagatgcaaaagttggcttctcttgccactgtggcaggggcgacatcgccaaccggaaatttcctgttgaaagataagtgggtgatcctgactactaccggagtatatacttataagtttgctaccggagagatggccgcagatcctcgtttgaatattaaaaagggagaattgatacgtgataatcgtggagattattggatatacaatcatacgggacggcttacatacgtgcttgccgaaaccggagagagtaaggatttccagttgattccccaggataagataagttatatcgactttgaacgttatcatatcgtccatgattctcggggaattatttggatttcgacctatggaaatgggcttttcgcttataataccgccgaagataaactggagcattttgtggcgaacattaatgaccagagtcatatcagttcggatttcctgcaatatgtgatggaagatcgtgccggtggcatctgggtagcttcggaatattcaggcttgtcccgtatttccgtattgaatgaaggaacttcccgtatctatcccgaatcccgtgatttgttcgaccggtcgaacaccatccgtatgcttaccagaatgtctaatggggatatctgtgtaggtacgcgtaaggggggattatacacctttgattcgagccttcattcgaaaatgaccaatcaatatttccattctaatatctatgctctcaccgaagacaaacagggacgaatgtggatgggaactcgtggaaatggtctcaaagtgggggacacctggtattataataatccttctgatttgacagccttatccgataataacgtttttgccatttatcgcgaccgtaaagaccgcatgtggataggaacatttggcggtgggctggaactggctgaacctactcccgacggtaaatataaattccgtcatttcttccagcaaacattcgggatgagaatggtgcgtgtgatagaagaagacgcaaatgggatggtgtgggtaggaaccagtgagggtatttgtatttttcatccggattcattgattgcagatgctgataattatcatcttttcagttatacaaacggaaagttttgcagtaatgaaatcaagtgtatctatcgggatacggaagggcggatgtggattggtacgtccggttcgggactgaatctttgtgagccgcaggataactattgctctttgaaatatgaacattacggaacttccgaaggattggttaacgatgtaatccagtctattctgggagataaaaaggggaatctctgggttgccaccgaatatggtatttccaaatttaatccggctacccattcttttgaaaactatttcttttcttcctatacattgggaaatgtgtatagtgagaatagtgcctgtatgcgcgaagatggaaaactgctttttggcacaaactacggattaatagtgatcgatcctgaaaagatacaggataacgaaactttctccccggttgttttcacggatttatatgtcaatggaacccagatgaatccgcagatggaggactctccgttaaagcaatcgttggcttattcggacgaaataaccctaaagttttttcagaactcattcttgatagatttctctacttttgattattcggatagcggccataccaaatatatgtattggctggaaaattacgatcagggatggagtgctccttctcctctgaattttgcttcgtttaagtatcttaatccgggaacttatatacttcacgtcaagtcgagcaatggatcaggtgtttggaatgatagcgagactacactgaaaattgtaattgtccctccattctggaaaacgacttgggcaatgctgggttatgtgctgttattaatcatagccttgtactttgctttccgtatcgttcgtaactttaacggcttgcgtaaccgcatcaatgtagaaaagcagttgacagaatataaactggtgttttttaccaatatctctcatgaattccgtactccgcttaccttgattcagggagcattggagaagattcaacgtgtgactgatatcccgcgtgaattgatatatccgctgaaaacaatggataagagcacgcagcgtatgttgaggcttatcaatcagttgctggaatttagaaagatgcagaataataagctggcactctctttagaggaaacggatgtcatctctttcctttatgaaatattcttgagtttcggcgacgtggcggaacagaagaatatgaacttccgtttcttgccttcggtgccatcttataagatgtttattgataaaggaaatttggataaggtgacttataacctgctttcaaatgcatttaaatatactccttccaacggaacgattattctttcggtgaatgtggacgaagggaaacaaacattgcaaattcaggtttcggatacaggagtggggattcctaaagagaaacagaacgaattgttcaagcggtttatgcagagtaatttctccggtgacagtattggggtcggtctgcatttgagccacgaactggtgcaggtacataaaggcacgattgaatataaagacaatgaaggtggcggttctgtatttaccgtatgtattccgacagataagacggtgtattcggagaaagacttccttgttccgggcaacgtattgctgaaagaggcggatggtcacgcacatcatttgttacagctttcggaagagcttcctgacccggaaaagatggttgctcctttgaataaacggaaagtgctgattattgaagatgataatgatatccgtgagtttctacgggaagaaatcggcgcatactttgaagtggaagtggctgccgacggcacgtccggatttgaaaaggcccgtacgtatgatgccgacctgattatctgtgatgttctgatgccgggtatgaccggatttgaagtaaccaagaaactaaaaacagattttgatacgagtcatattcccattatccttctgactgcgttgaactcaccggaaaagcatctggaaggaattgaggcaggtgcggatgcatacatcgccaaaccattcagcgttaaactgctgttggcacgtgtattccgtttgatcgagcagcgcgataaattgcgtgagaagttctccagtgaaccgggtattgtgcgtccggctatgtgtactaccgaccgggataaagaatttgcagaccgtttggctgccattctcgaacagaatcttgcccgcccggaattttctattgacgagtttgcgcagcttatgaagttgggacgaactgttttttatcggaaattacgcggcgtaacaggatattcgcctaatgaatatttgcgtgtggtgcgcatgaagaaagcggcggagttattgctgtcagaagataatctgacggttgcggaagtctcttacaaggtaggcatcagtgatcctttctatttcagtaaatgctttaaagcacagtttggggtagcaccatcggtttatcagcgtggtgtgaatagtgaaggagattccatgtagaacagatttttatccatttcgcttccggacctttatattgaataatagtccttgtatttgtgtacaatagtccattgtacaatagggaaggtacacctatctttgcagggtaaatagtgtgtgactatggctttcatattcatatctttaatcatttaatagaatcatgaaaacactttctttatttattctgacttcttttttctatattttgggtataagtaccctatcagctgccaattggaaagtttacgttgccaaatataagcaggacaaaacttgtgctatcacctatacttttgatgatggtttggcagaacattccacagtggctgcgccggaattggaaaagcgtggctttagaggaaccttctgggtttgcggtttttatacggaacaaggggcatcatccaagttacctcgaatgacttgggatgaactaaagcaaatggcaaagaacggacatgaaatctccaatcatagctggtcacatcagaatgcgaagcgtttgaccttggaacaagtgaaatctgaaatagagaagaatgatagtgcgatttttgccaatataggtgtgatgcctgtcacttattgttatccatataactataagacagatgagatcgttgcgctggcttctaaaaacagagtgggaacacgtaccaaacagatttcgattggcggaaaatctagccctcaacgatttgccaaatggctggatgatttaatgacgaaagaggagtggggagtaggtatgacgcatggaatcaattacggatatgatgcttttaaggaaccttcgttgttttgggaacacttggataaagtgaaaagtctggaagataagatttgggtaggtacgtttcgtgaagtggctgcttatataagggagagggatgatattcgattaaacgtttccacacataagaggggattgacgattactcctgaaatgacattggacaagaaaatatatacagaaccattaaccatggtgcttgtgggagaagcagtagaaaaggtgtctgtgaaacaaggtaaaaagcagctttccgcacatatttccggagataaagttcttttcgatttcaatccgtatgcagggaaaattaaagtaagtttcaacaataaataatctaagaatgtacatgaaaaataaattagtactattactctttttcatattgacaggtgctgtcagtgtaaatgctcaaaacttgcccgatcaaaaggaaacattggaggtcatgaagaaagtgaacggttactttatgaaaaagtatgccgattatactatccccagtttttatggtcgtgtacgtcccagtaatatctggacacgtggcgtatattatgaggggctgatggcgctctattctatttatccgcgtgaggattattataagtatgcctacgattgggctgattttcacaaatggggaatgagaaacggcaataccacccgtaacgccgacgaccattgctgtggacaaacgtatatcgacttatataatatttgtccgtcagacccgaacatgatccggaatatcaaagcaagtatcgatatggtagtgaacaccccgcaggtgaacgactggtggtggattgacgctgtacagatggcaatgcctatttttgctaaattcggaaagatgactggggaacagaagtactacgacaagatgtgggatatgtactattatacacgcagtcagcacgatgaaaccggtatgttcaatcagaaagacggtctgtggtggcgcgatcaggatttcaatcctccctataaggagcctaatggagaggattgctattggagtcgtggaaacggatgggtatatgctgctttggtgcgtgtcttggatgaaattccctctgacgaaaaacaccgtcaggactatgtcaatgatttcctgaccatgagcaaggcattgaagaagtgtcagcgtgaagacggtttctggaatgtcagccttcatgatcctacgaacttcggaggcaaagagacttccggcacagcactgtttgtttacggtatggcttggggagttcgtaacggactgctcgaccgtaaagaatatcttcccatccttttaaaagcgtggaacgctatggtgaaagatgccgtacatccgaacggattcctgggatatgtacaaggtacgggtaaggagcccaaagacggtcagccggttacttataagagtgtacccgactttgaagattacggtgtaggttgtttcctgcttgccggaacggaagtgtacaagctgaaataatagaataatatacacttctccatgggtaattatactccggtagccttacttcccttgaatggataattgccaaggtatttgcgtacaatcgtccattgtatacttcaataagtacgtctacatttgcaggagtaaaaaactaaaaaaaacaataacttaaaatgaagacatcaatgaaaaacatgtatttagctgctgctatggtagtgtcattagctttttctgcttgtagtgatgaagagtcgggaaaggcggatcgcgcttataaacccatcgaaatttatggaaatatcaatgaagtggtgaataatgtacaggaaactcgtgctgtcggtgcggcatggggctcggacgaccggattggagtgactgttgaagcggatgaggataatgcgaccgctaatgcagtggatacctatattaatatccaatatcgcaatgaaaccggaggttcgttccgtgttgtgaacgaaggctcaacagacaataatatccgtttgaaaggagaaggtgagtttactttgaatgcttattatccgtatcagggagcgaatggtacattgccgggtacagaaggagtgattgcaaaaacaatcagcggagcagaccagacaaccgacaaacagccacaaatagactttctatttgcccaggctaccggagttcgtgcagagtctcctgttaccttcgacttctcacataaaatgactaaaatcatattgaagtttaaagcaaccaacggagctacattaaataatatgaaagtctatttgaaaagcctgcagttggaaggctcttttaatgtgactaccggtgaggctgttgccaaaagcggtgctactccaaattcagaattaagcatggatattgctaaaccggcagaaggtgaaatgactgcatccattattttattcccacaggatatgccggagaaagttttgctggaagtgagaatgaatgatgagacctacacgcaatacatgcctgttcagaatctggagagtggacatgcctatccttataatgtgaccttcgaaaatcctgcaatgacaatcaccaaagcggaaatagaagactggatcgtagaagatgataaagatgtaactgcttcggttactgaataaacgactgacaaggattcaaaaaaagaatgatatgaaaagaaatgaattatggctcggctgtttattggcagtagcaggtttcttcggagcttgtaccaatgtagtggaagacgagtctcaaaataataaatatccgatggagctaatggcggaaaagtcagctataactttcacgcgtagcatcggggagaagactgaatgggatggaggagagcttgtttccctatacgatggtttctcacaaaagttgtatgaggtttctcaatcaggagaaatgagtgctaaaaataacgatcctctttattggtatacaacgacggaagaagagactttgtttgcctggtatccttcttcggaaactttgttgacagagtggaccgtagcttccgatcagactattgaagaatcatataaaaactcggatttcctttatgcctatgagaaaatgaaattccgtagcgagcggaagcttaaattccatcacggaacggtgaagctgattatcaacgtgaaaggtgacggagacactgtatcggaagaagatttgaaggatattgtgttcactgtaagtgctgtaacaaagggcagtatggcagaaggcaaattacagtctgccgcaggagttgaagcgacagtgatgaaaccttatttgttggaaaatgccagagaaggatacgcttattcttttcagttgctgatgattccgcaggatatgtccggcaaattattctttaaagttgcgttgaaagacggcaggaatttcggtcatacgccgggcaatggtgaaggcatattagaaggtggacaccaatatacatacaatgtaggagttggtaaaccgggattgaaagtgacaatagaaaaagattctgtttcgtgggacggtgatgacgaagaggttgaaggaactgatagagaataatattcaaaatttgaagcgaagatgaaacaatataaacttatgcaagtggccttgctggcaatcctattgttcggttgggctggttgttctcaaaatgaggaagaagttccgggaaatgtacggaatgggattgtactgaacgtgactgatacagggataattagcaatgaaccgtctacgcgtacagaagatacgggattcgtcacgacctttacacaaggcgaccagattggactgttcgccgtgaaagacggtgcgatattggacgaaatcaataatatgcctttcactttcaatggttcgagctggtcgggtaaaccgatattgtatgatgatcgtctggtgggagtgaatttctatgcttactatccttatcaatcggaaatgacaggaaaaacggatttgataggtgatgatttttttgctcctctggcagccggttgggaattgacaacagaacaaagtgatcagaaagcatatgcgaaacaggatttgatgacctcaaatgcaactgcattgattggtgagaacggaaactactcattgagctttcagttaacacaccgtatgagcttggttgttgtgaagttgccttccactcgttatatctttacagatgccgaaggagtggcaatgccggaagaaactccttatgttgctatgtctgtcgatgtagctttttatcttgataatgtggaggaaggaactaaaatttctccttattatgacgcaaagaaagatgaatatcgtttgctaagaaaaccgtcttcggaaaatcagattatcggtcattataatgataagcaatgtacgcttgatacggctgaaaagatgaaagaaggaaaatacaaacgttttgttgtcgatggtggatataaagaggtgacccatcatctgcaggtaggcgattattattatgcagatggaagtgtggtaagtggcaatgaagcagaacctgcaaaggataattgtattggaatcgtttgttgggtgggaaatccgatgccttctgtgttgtataaagatgtggcgggaactccctatactgccactaatgatgcattgctccgttcgcatcccaattgtgttcatgggttagttatgagcctctatacagaaacgggcaaattctctcctgctcttactcaaagtatacacgactggtttatgactacttcgtttacttcttcttatgtatctgttaccggatattatgatgcaaatgaaaataataaaaacaaacctcttcgctttttgggatataacaactcggaagtattagatttgtactacgatactttcaaaacagattttgaatgtttccaatatcaggatgattgtgaaagtagcttcccgtctccgtctataactaccggttggtatgtgccttccagtggggaacttgttgctttgcaggataaagataattctttagagagtaagctgaatactaagttgataaaagtatcggataaaacaatggatatatctgctacctattggagtagtacggaacggaataataagaatatgtacattgttacttattctaaaacagctggctcggcaggaaccggtggtgtcaagaccaatacttacacttatcgttttttcctgggattctaaattaaagatatttgtatgatgatgaagagaatactatttcttattagtcttttgttggtaaccggttgccttttagtacgtgcgcaagtctataaattcgactttacttccgacaaaaaggtaaaagagggatatactaaagtgacacccgaaaccttgttcaatgacgaacaaggttacggatatgatttgcaaccggcatgggatggaaaaagtaatcagcctttcttcttctccgtcaatgttcccgatggcaattataaagtaaccgtcacccttggcagtaaggattcagccggaaatactacggtgcgtgccgagtcccgccgactgtttattgaaaatcttccgactaaaaagggagaaatgattaccgaatcttttactgtcaacaagcggaacatgaaaatcagcgaaagagagaaagtcaaaatcaaggcacgtgaaaagaataaactgaactgggatgaaaaactgactattgaatttaatggtgatgcgccccgtatcacttctctggtcattgaacgtgcagataaagtgcctaccatttttctttgcggcaactccaccgtggttgattatgataacgaaccttgggccgcttggggacaaatgtttccacggtggttcaccgatcaggtagctattgccaattatgctgaatccggagaatctgctaatacctttatcggtgccggacgtttgaaaaaagccctgacacagatgaagaagggcgattatctctttatggagttcggacacaacgatcagaaacagaaaggacccggcaaaggagctttctattctttcatgtataatctgaagatttatattgatgaagcccgttccagaggtgcgtatcctgtattagtgactccgacgcaacgtcgtcgttttgataagaacggtaagattgtaaacactcaccttgattatcctgatgcgattcgttggttggcagccaaagaaaacgtacctttgattgatttgaatgaaataagtcgtacactttacgaggcaatgggcgaagatggctctaaacatgcgttcgtgcattatccggctaatacttatccgggacagacaaaggaactgaaagataattcccactccaatactttcggtgcttatgaactggctaaatgtattattgaaggaatgaagaaagctgatttggatgcggtgaagttcttgaggaaggattataaaggattcaatccagaccatcccgacagattcgaagactttaaatggaatctttgcccgtttacggagatagagaaaccggatggtaattaataaatggaaatataatagcggattattccggttcaatatcaataaataacgtagattaaaaacataaaatagaagagggattatgaaaaaagtgtttgtatcaatggcgttggcagttcttgcattgggaagccaggcacaagttttgaagaatgacctgttgaaaggttataaggtaggcgatactttggagaaaacggtttatgatgataaacgggctcctattaacgtagatacttggtgtggagcatttactacgacatcggttgaaggagtggtaagtcctactgttggaaaggctttgacttatgacggatatagtgaggcgggatcatctatcaattttggttttccgcaaggtgtgaaaggttcccgtgtcagcgtatattctttggtagaatcaggaaaagtttactctaaaggaacttattacctggcttgtctggtgaactttgctaaagtcggttcaagtaatttggcagatatcttggctgccagtgccagttatgttggcggaggaaatcgtggtcaagtatatgtcagacgtgaaggaaatgataaaatcaaatttgctgtaggcttgatgaaagaacgtaacgaagctcctatggtatatgattataatacaacgcatctgctggtattgaaagttgattatgacaagaatgaagtttctttattcgttgatcctgatttaaatcagaatgaaccgaaagccgatgttgtagtggctggtgaagaaggtgcattgaaagctggtctgaaagctatttcgtttagaaatcgcagtggctttaaaggaaatatcggtaatttccgctttgccagagattgggctggcgctataggaaaataatagaatatattaatctattaaatagaagagggggagagttgcattgtagacaactttcctcctttttgagttgtggtaagctatattatattcttgaatcactgcttgtcttgtaattcacgtaatacatcatttataatataagtatcgctcattagatgcagaccgtaacgggagtcatgtaacatggcacatacatttgtttcataaaacagatttaatgctcgttccgggcttatctccaatcggaccgataataataggatgatacgacttatttttctccaaagtacttgttctctcatttattacctccttttctgtccattgtatccagtggaaaactcttatcaaaatgtagctgtgtatcaatgagttgctgattgagcagacattaccgaaatctaaatcggcacgtcccactttggctaaaggatgctctatagaaagggtggaaccatgataaagtgttattttcatacttttccgccctcctgtgcttcccagtttttcaaagcttcagccacatcctcgcctacatgttttaggctttgtgtgtgcatcacttcgtaattgtccagtagaagacgtttgattaggttcattttctctaaacgtcggcgcatttccataggagaaattcccatttcgcgtgctccggcttctatcgccatgactgcaaagtgaatcttttcactttctaggatatctggttgtttacacataagcattaaaattcagtttataaacaaagatacttgatggcaggcaaataaacaacattgccggaacttttttgtatatacaagtaaaagtcctccaagctgccgccggaggactttcactactaaccttcaaacaaatttataaatagtattatgtcgcttaattatatcctttattctgttcgtacaatccttcttttactttcatttgtgaatccggtatcgggtagatgtatgagtctttggtgaccagtttgtataattcgtacgtttccggcttggtgattactccgttggcatcggaaccattgcgcttgaacatatcctgcaatacacctacatatcggttctgacgtaccaaatcgtgccagcggattccttcagatgccagttcacggcggcgttcaatatctacagagtctgcaaaattctcgatggtaatatcatcatccaaagcatccagtccggcgcgtgtacgaatcttattcaccatttctttccctttgccggtaggtcctacaatttcagcatacatcaacatcacatcttccaggcgaattagtggataattgatggggaaataggtgcggtcggcaatctggtcatcgatgtcttcgtatcctaaaagtttgcgtttcattttgtgctcgaagaatttcaggaagaaatcccctcctgtatatggagttccgtcttcgtcgacaaattcacttgtattgatagttcctgcacaacgtttgtcaatgaaagcacctgtttcgtcggtttgcttgaaaataccgtccaattggttctcacaccatattctgttaccggacatttgtatcttcgtataagaatcgttgacagccggtacagagttgaataccattggattaccatagttcttggctgcaatatactggatctcgaaaatatgatatttgttgtcgttgtcactgatccatattttaatccattcgtcggctgtgctcgcccaatatttattgttggcgaaagaataatcgatcacctcgctaaatagttcctcggccaacgcctttttagatgcatcctgtacgggatatcctgccattgtcagataaacgcgtcctaataaagactttgcagccacttgggtagcacgcccggctgaagcgctgtttcccatataattcagcggagtgtctaccagtttctttactgcgtcctccaaatccgggacgattgctgtctcatatacctccaccggttcagactgtttgatcgtcatcgcttcattcacagataccggttccaatacgataggaatacgtccgaagtagcgtactaagtcaaaataagccaatgctctaaggaatttggcctcgccgataaactggtttttgatagcttctgaagagaaagtaaccccgtcggttttgctaagaaacatattggcacgggctataatctcgtacagattattccaggctccggaaagggtactgatggtagaaatgttgggattgaaagttcctatatcgatatagtcacgttgtttatccgtcgttttatccacccacgcattgtctgaacgaacttccgacataagccaggaatagtccgaaataggaagcaggccgttgtagataccgataatggcttgttccatttcactgggagttgaatagaaatagtccgtggtacgtgtgtcgttaggctccacttccagccaactttcacaagaggacagtgacaatgtcagcgctaatcctccacttataagatatttatatagtttcatagtttctttctttttttatttagaatgtaacattcactcctaacgtaatgactctggcttgcggatatgaaccgtagtcatagtctcccgttgaaccgccattgttagcttcaggtgagaaaccaccttcgtatttatcccacatcagaagattttcccctgtcagataaacacgggcattctgtatgaacttctttttgaatggaatacggtatcccaatgttacgtttttgagttttatgaaatctgtactgtataaccatcggctgtcatagaactgtcccgtattggcgttgtcgatacccggagtttttccgtcgcccggttctgcttccgatttccacatatttttccaatgagacaatacattaccgttggctcccatacccggacggtccatggcacgtcccaggacgctgtaaatctggcctcctgtctgtgcggtaatcaggaaagataagtcgaagtttttatacttgaaggtgtttgttataccgaaagtataatccggatcgggtttgcccatcaaggtgcggtcgctgtcattgataactccgtcgccatttgcgtcccggtagcgtacgtcgcccactttgctgttctgcattacaggatatttttgtaagtcagcttgtgtctgatagactccgacagcatcgtacatataaaaagatctcaatggctggtccaccataaacacctgtgtggtgctgtcatatcctgtaaatacagtgctgttatcatctcccaggctaagtactttgttctgattgtaagaaacgttcagagaagtgctccatttcagtctgcctgtcagattctgcgtagttacttccagttcgaaacctttgttacggatagaaccgatgtttccccatgctttggtaaagccgagcaatgcgggaacagtcacctggtataacaagtctttggttgttttcacataatagtcggcagaaaggaagatacggttgttgaacaatcccatatcgaaagcaacattccagctttcagtcttttcccagccaagatcaggattggcgagcgatgtcggtgcaaaaccgttgataatacttccggatgaataattggcactgcttagtttggcaagcgctgtatttgtaggaatggagttgttaccatttgttccccagctggcacgcagttttaatgaattcatgacgaaatttttcggccagaatttttcgtttgagatacgataagcaccggaaacagccgggaagataccccaacggttcgcttttccgaaacgggaagagccatcacggcggatacttgccgtcagcaggtagcgatcgtcatattcgtattgtaaacgtccgaagtaagacatcaggcgggatggagttgataaggacgctgtagcagcagtgagtacgacgtcggccatatcgatcacttccagagagttgtccggaaattgagtggctgataatctcatggaagaaccaccggaactttccatagaataaccggccattgctccaacagtgtgccggccaaatgtcttgttgtaatgcaacaccccttggagaaggaatttattaccacgtgattcggtacgacttgctgtcgttctgtagccttccacatccgtccggtatttggtgatggtgctcggtacgaaagaacggctttgggcactattaaaattatacgaaccggtcacttctgctttaatgccattccatatatccgctttaatataggcagatgaactgaattgcaccttttctcctttgttttgtacatgttccatataggcaacaggactgattttgctggaactggtccaacgatagtagccgtaagcccctgcaccggtatagatgccatcttcaggttctgcaaccggagccatggtaagtacgttcgttgcctgacggtctttaccatctacacgtcctccttcattccaactggcagatggtgccagattaactccgacagtaatccggttgaatactttcgattctacattggcacggaaattcaagcgcttataattactttcgatagcgataccctcctgatctgtgtatcccattgatacacgatatttagtgttaccgcgaccacttgaaagagagagttgataattctgtatcggagccagacggaagaattcatcctgccagtcaatcaatttcagattgccgtaaccgggttctgtccagcgggggtcattcaggaaataataactttcctttccaccgatcattgccagacgggtagcgtaatcatcttcaatcgttgcccctttactcccgtattgagaaatatatctgttattattatatgcggtacggaattcaatccattcttcgggcgacagtacatctacttttctttccaatgactgaataccgaaagaggcctggaactgtactctcactttttcatcagtaccggcttgtttggtggtaatcaagacaaccccattggcaccgcgggaaccatagatagccgatgaggaagcatcttttaatacttcaatagactgtatgtctccggggttgaggctaccgaggtcatcgacaggaataccgtctactacatataaaggagtagcatctgcgttgatagaagcagctccacgtacacgaatctgtaattcggaacccggttcaccggtggtgctacgaacttccacacctgccagttgtccttgcagggaagaagcgatattggttgatgcccggtcttccagcttttcggcatttactttggcgatagctccggtcacatttcctttcttggcactaccgtagccgattgctacgacttcatccagtgcgatagcggattccgacagtttgatttgcagcgttttatcggtaatggttactgtttgagtgttatatccgataaaagacacttccagcagtttggcacttttgggagcggagagtacgaatttaccgtctaaatcagtaatcgttcctttggcggttcctttcacagtgacgtttgcaccgataatcggttcatctttctcatctacgactacacctgtcaccgtccggttttgtgcgaacgacagggtagattgtactacgaacagagtcattaaaaggagatattgaatcttccttcccagactgccatttccatgcaaaatgtttttcatgttaatatctctaagtgattaaattagtaaataacggaagatgcagacatggtttgtttttccatttgtctgacttcctctgcaaaggaagtgtattaggagaaattacgctcaagtattcgtacggaaaagatgtaatttcatactaattgctaaaaaacacatttggcatttgtacgccaccccctatgaacgtacaaatatagccttttcaacggattgcctttatctgttcatacatctgtttgcccaaatattcggcagaattttggttgaaatgcaaacggtcgcccatcaattccgcatccgacatgtctatcaaatatgcgttcttatcttctttagcaaaacgtttcatggcggcttccacttcgctgccatactgtttgttcttcttggctaccgtaccgaaaataaaaggtaggttggagtaatcttttcctgttttttcgcttagatggttgcgtacataagtgactactgctttcaggttttcataatatttatctccatgtgcatggtcactttctccctgatgccataggaatgcatcaatctgataaccgtttttcaacttggataatgtattgtcgatgcagccgtctatgtcattgatgaaggacagaagtaaagaacgtcctttctcactggttgccgtattatttgccagccattcgggatttgccgaccaatgaattgatttgtccgaagcattggaaggctcgatagaagttccgccgattgcccatttgataacatagaaaggctcttgccaccattgttccagccaatagtaggtaatagcatcgtacccccaggtattgggtttggctcttcttttactcttaggccagaagggacggaatttcccgtctgtacggttctgggcaattctgcaatacttgtaggctcctgtcgtaaaagccgtatctgttgccattgttttgatgtaatccggcaaacggtcgttgggtacacgtccgtcggtattcgattgtccggcggtgataatcacatgggcaggttcgttgttgcccgccatacagttgcagctgaatgcaagtatgaaaaggatcagtaaattcttcatgatagaaatatgctttatgattttataaactatggaggtaataaaaagtcctcctcacgtttattatcgctcgggaggacttcttatcaaactaacaatcgtgtgagaaatctaatacctgttgagaactatttatttgattgtttcgagaaactctacttcgatgattcttaactggtttttgctgctgcttttttccagttccattttattggcggccttagcctctacttcgataatctgtccgaaagcatctttgtcactagtgtttcctttcaagcggatggttatcgtattggcacgtacgggcttttctatattgagatgaatatatcccaggcttttatccgtgtttccgctccaaatcaaggtgttgccggcatatacttccagcgggtaacttcgtgaacgccatccttgcagtttgatgcatatatcgtctatttcggcatctctttccaatgtataggtaatccatgcagtgcttagtttgccgtcattcttccattcggtcagttcgatatcatcgtagcttttttcagcatcattattgttggaaccggcttttgccgaaacgattcgtacgccctttttgctgtctttgtaagaaggggtagaaggtgtttcgcctctgtccagtctgcctttcaaggtagactgcggaagataggaactcaaacctccagtcacttttacaggcaccgtttccaatgtgagagaggcacttggaagtcctttagcctgtgctgtcagagttacttttccggcagtcgtcgtactgcggatcagtgcgcggttgataccacattctaccggaaggtttgtatcaagaatatgattgttttcaccttgagcaatacctccgcgccattccgcatgaccgttgagtgtgaactgaacggtgcggttgtccaacggacagcgttttccgtctttatctaccacttctacctgtatcaatgccatatccgcaccgtctgcatgaaatccttcggggttttggatagcggtaagtttcagactggcaggttcaccggctgtatttagagcatagcggctgatttctttccctgctttattgtagctgacagcttccagcttgcccggtttgaaggctacgttgtcgaaagtaaagagaaaattgtattggcgtttgcctttacccagggagttaccattcaggaaaagttccacctcttctccagtagatactacctgcacaggttttaccgtattttccggatagttccaatggccgatgatgtaggtctggtctttttccgtatctacccatccgtcccacattacctgatgtgcgtagaaagcatctttttcgatacgcatcgcgtccgtcactccacttcttcggtagttttccgcaccccggtaatgagtgttagtgtcggagaagataattttagtaccgccggagctgactctgttacccgttccgggacgctcacgccaataatcataccagcgggctatcatggtgatggcaagctcatcttggttgcggttatagtcagtggccggttgtcctttataaagtggtccgtcaccttctttatggaaaggatagctgtattcatcccagtactttcttaaaccttcgtcgcggcaatattcggtcgcccacatcggatgatgttcgcttctgttaatgtacagcatttcgccgccgtattctgcttcgcggatatccaacatttcacgtgatccgatggcacgtccgccgaacgggtcgtatttgtcgcggacagctttcatttctatcatgtgttcgcggctgatggctttgttgccacattcgtagaacaggatactcggattattacggttgtagataatcgcgtctcgcatcaactctacccgttgttcccattgacgtccttcacggtctttttcagcatctccggcaggcattgcctgtatcagacctacacggtcgcaggattctacatcctgtttccacggagtaacgtgcatccagcgaaccagattcgcgtttcctttcaccatcaggtcattagagaaatcgctcaaccaggcaggtacggacaggcctactgccggccattcgttgctggtacgctgtgcatatcctttcatttggataatacggtcgttcagccatatctttccttctgcaaaacgtgtcttgcggaagccggtgcgggtacttacttcatcgaatacctgattgttgtcatctttcagagcggtttttaccgtatacaagtaaccatatccccaactccagaagtgaagattatggagggtggcggatgcttttaccgttttagtctctccggctttcaaagtcactttatcaccttggaaagttttcattagtttgccgtctgcatcaagtacactcacttgatagctgaattgccggggagctttactgtcatttctgacttccgattcggcatgaatcgtagctttgcgtccttggatgtcgaagtcttgggcatagacgtatacgcctgtcgttttcaggttgctatataggggaagagtctgatatacattatcagtaacgtacaagaagacgtttttaggaataccgccatagttggcattgaaattgcggtcgttccactggaacttagagttagttccttcttctctgtacatccagtcgttgtcggtgcgaacggcaatcacgttctcaccctctttgatatgtggagtcaggtcgaaccctaccgccataacaccattttcgtgtctgcccagataatgtccgttgagatagaagtctccgcgttggcgtactccttcaaattcgacgaatactttctgattacttttcagttccggaatccggaaattcttgcgataccataccactgtatctgtcaattgttcgatggaaagtttgaatgcttcgtcttcattgaaggcatgaggcaaagtcacttgtttccatttactgtcgtcgaattttgcgtctttggctttaggaaagtctcctatccgcagcttccattcgctgttgaaattgtattttttgcgttcggatgcctgtccgttgatgacagacagtgcagtcagcagaaatacgaaaagaaataatttgtgtttcatgatagtctattaaaatgttctgctgcaaaggaagtacattgagagaaaacatacatatactaccgtacggaaaggatgtaatttttatctcatgatgaaaaaaagcgactggtatttgtacacaatttcagataatagtacacattccccgttgataggagaatgagatactattatctgcggttagcacatgttctttttaaacatccgtttcattctcttcttctttttcttcggaagcttgttctgtgttctctgccgtatcattggaagccggagctttaccaccgttcttctgataaacagaaggggctattccgaattgattcttgaagcatttgctgaaataatagggatcgttgatacctactttgtaggaaatctcggaaacagtcaggtcttcggttaacaataattccgcagctttcttcaaacgaatgacacgcaggtattcattgggagagtatccggtgacaccacgtactttcttgtagaatacggtacgtcccaatcccatcaggttggcatagtcatctacggaaaattccgtttccaccatgtgctcgttcagcatttcattcagttttgccaggaatttgctgtccttgttgttcgtacagatagccgcatgaaccattcccggttcgttggagaatttttcacgcagtttgtcccgctgttcgatcagtttggagattctggccagtaataaggagatgctgaatggtttggtgatataagcatccgcgccggattcgataccttccagatatttttcttccatattgagggcggttagcagaatgatgggaatgtggctggtggcaaattcattctttaatttcttggtcacttcgaatcccgtcatacccggcattaatacgtcgcagataatcagatctgcatcataagtttgtgcacgttcgaagccactgataccatccgcttctgccactacttcgaagtaatgactgatttcttctttcaggaattcgcggacatcattatcatcttcaatgattaatactttccgcttgttcaacggtacgggaggtgctgcctgttcgtccgtattttcgtctgtgacaaactctttatggcgttgtttctcttcttcaatcaataactggttaggaaccaggaaatctttttcttcataaacactggcgtccgttggtagttcgacggtgaagatggaaccgccgccttcattctcattataagaaatcgttcctttatgtatattgatcagaccgtatgtcagatgaagtccgacgcctacactgctgtgtgagaagctgctttgcataaagcgtttgaacagttcggcacgcttctctttcgggatgcccagtcctgtgtcgatcacttgtatgcagagctgtttcttctgttcctgtacgtctactttgaatataatctttccgttggaaggagtatatttaaaagcgttggagagcaggttatagatcactttatcaagattccccttatccacaggcatcttgtaagagttctgtgagggctcgaaacggaaatccatgtttttggattcgctgacgtccttgaaactaaggaatatctcatagcagaaagcgacaacatccgtttcctccagggagagggcgagtttgtttttctgcattttccggaattccagtagttggttgataagcctcaacattcgtttcgtgctcttgtccatgatcttcagggagtgttgcatatccttggagtggtttcccatgttgacaattctttccaaagcaccttgaatcagtgtcaacggagtgcggaattcatgagagatgttggtaaagaattccagtttatactccgtcaactggttttctacagcgatacggttacgcagcgcattgaaatttctgataatacggaaactgaagtaacccgctatggctattagaatggcatagatcaggtaagcccatccggttttccagaaaggaggagctattacgatttccatcacattttcttctccccagataccggcggcgttgcaggctttcacatgtagttcatatttgcccggaggcagattccggtaagtggcaaagttcaggctggagggcgaactccattccgtatcgtatggaggaagactgtaagagtatttggataccccgtccagatagttgaaggtagagaaagagatcgtgagtgaactctgataatatttcaggttcagttcgttgatgtaaggcattgcttcttgtaaaggcgaatcctccactcccggaagcatgtgcgcaccgttgatttgaagtccggtgaagataacggaggcaggcttgtccaacgtctctatcttgttggcatccagtactaccaagccatagtttgttccgaacaataatttgccgtcattgctgacgcaagcggtgttttcactatatacatttcctaaagtgtaggaagagaaaaagtaattttctatctgtttggtagccggggtgaaacgggagatgccatattcggttgcaatccacattttatggtccttattctggacaatggattgtacgactgcattggataatccgtcttttatatcatagcaatcgaaagtcaggtgttgatagctgtctcccgggtggcagactgcgaatccggccccggaagtaccaatccacatattacctttatcatcgttcatcaaacaacggatctcgttgctggggaatgtgccgttggcatgattgtaaatcacgtaattcttgggtgatgcaatcagtgaatccggatggaagatataaataccgttgttcgtgcctacccacatgcgtccgttcttgtcctcttcgatgacacggatgcgtttttcaccgtagttgtcttgtaagaagtgtttgaactggtagccgtcggtagttttaattgctaaatttaatcctccaccgaaagtgcctagccacatacgtccttttctatcgcgataaatggagtaaacctggtcgttggatagagagttagcgtttctggggtcattcttataccatttgtttgcgccgatgcgaaggccgatccctctcattcccagccataagttgccttcctgatcttcgttcatgctgtaaacgttatgggtgaagtcctcttgccggatcactttggtcagggcagagttgtattcgtaaaggctacccatgcggttggccatgtagatattgccgttttgagtctgaaagagcatgcggatggtattcgagcggtcggaactgttttcaccgctgggatgaatacgctgtgttcctttgttcagaatttccaaatgagataaacccgagaattcggagcttacccagatacctccggaacggtcttccattacaaattgaagatagttggagttgatgtggctggattgattgacttcgaatgtgaagtgttgcaggttacccgtcgataattcataagcgtaaagcccgttgccgtaagtcgatatccagagaatgtcccgtgagtcgtgtacgatgctgtaacgttccacatcgatgtaaccgatatgtttggaggaaaggaactggaaaggtttgattttgccggtggttatatcgacgtaccataaattgcccgtatagttatgtacccatacatttttcttattgtccctggtgacagcgccatttttgatattcagttccgagtaacgacttagtttaccggtcggaatatccagtatatagctgccgttgacggtaaacaatacccatttatcctgcaagaggaagttgcctgtgacgtggcctatatcatcaaagccctcggctaacgacgcaaccttttccagcttgtccgtggaataggtatgacggtagatttcatttttatcggtaatgatacaagtgtatttatcataagaaatgatgtgttcccagttctgttgttgcgggtcgaggttgttcgttttaccattctgatacttcaataaccctttgtccgtaccaatccagacttctccttttgcactttccagaacgaattgtactttatcggaaggcaggttgcctgatttctctttatacgcttgcgatgaaaatttgccgtcctgataaacgactctgcggcaaccgttttgattatgccataaccaaatagagttgtcggaaaggataatgaatttggaatagttttccttgtattccccatttccggtgaaatctacaaaacagccatgacgcaaatcatagcaactgataaaagaagaaattgttgaaatccacatgaagccgttcgggtcttcttccatgcttcggatgcgggaatcggctaatgagagcgggttatttatatccggatagatattgacgaaagaattgccgtcataataacttaatccgttgagagttcccagccagataaatcctttactgtcctgcatcatatagcgggtcgaattatttgctaatccatctccggtagtcagcttattggagcgaatttccacggaggccgacagtggatagagataaagcaataaaagcgataatataaggaatgtattcttcttcatagtggatttatatgtgttatatgcaggcaaagatagttatttctttggattttaaacaaatctgcccttcgtatagtaaaataccaagggcaagagatgtgtatttgtggttggcgctgatacttttagtataacacttacttgatttgatatcctctgaaagtacctttcatctttataaggtccggtccgaaatagaatcccggttgtgttggctggttatagcctacattttgggtagcgatactgattctgtatatcggttcttcaaggaaggtgtggaatctgtattcggtcgggatagtcgatacgtagagccggagagaagcgttgtcctcggagcgtacgagtacttcttcccgccagtcgcctataatgtcaccttgcagacaaggattcgatttcgttccattgttgaaaagagttcctgtgaatttgacaagcggaacaaactttttattttcccagtcgtatttaataatcatgcttctatccagtagttcgcgcaataggtctccatcccaccagacagccatattggtcggcatatttctcattttgggggctatgatttctccttttacgtttcgaataccttgtgaatctcctgaccacatttccacacccggatgagtcgggtcaatgtcggcggccatacaacgtcctacatcggtattgctttttagctgcaacaacacttctcccgttgcagcatctctataagtggagccgtcacgtttgttttcatggcagtcccacacttgcagaccttttcgtgaagggtcaaaatgtgtcaggtggatggcgtctccatgtcccattcgggtagaataaagtcctttgccgttgtggtcgatagcacaggaaccgtaaatgatttcgtcgcatccatcaccatccacatcgcctacacgcagattgtggtttccttgtccggcgtactgctcacatccgggatggttgctgtcgaatacccaacggttcttcagttcttttccgttccagtcgaaggcagccagaacagtacgcgtgtagtagcctcggcacatgacaacacttgggtgtactccgtcaagataggctacacaagccaggaagcggtcgcttcggttaccttttgcgtctccccagtcggcaacgttgccgcgggcagggatatagtcgatggtatgtaaggcttcaccggtgtctccagaaaaaacagtcaggtattctttgcctttcagaatacgtccttgtttcattatctgatttctgctgggatcgaaagttccctcttcgcgatagtctgcatttgcatctcctatcactttccctttgctgtctattgttccgtcggcagtccgcatcactacttccgctttgccgtcaccatccagatcgtacaccatgaattgagtataatgagctcctgcacgtatgtttttacccaagttgatacgccatagttgttctccgttcattcggtaacaatcgatgtatacttcgcctgtatagccttcatgtgcattgtcgtgtgaattgctggggtcccatttgaggataatttcgtattcgccgtcaccgtctacgtcaccgatggaagcatcattgggactgtacgtgtaggtatcacctgccggagttattccgtccgccggtttttgcaggggaatttccagatagccgagaggcgcgttttccgggagtgtgtatgtaccgtcaatgtgatgcgtctccttgccttttagaacaggacgtacttcgtaaacagccgttttctgactgttattcttatcacggaacaaggtgctgactgtgatgggagtgtctgtcagtttcttcccgtctctgtacacattgaaaccggtctgtatcggatcggaagaaagatacctccacgaaacgattacttctgaagggttttcgcgaatggcaactacgccgcggtttagtttctcccgttgtaactttgagtagttataaccaggttgtgctgtcattgttgcaacaggcagcaacatgaatatgcacaatagataaattgcaattcttctcatatttgtttcatcggtttggaccttattatatttattcactcgcaaaattactccttttttgaatgtatgaaatggagaaatgtacaaagactatatacaattgtgcaccctttcaaattaattgtccgtatgatataatattctatcttttgcgtacatccgtccattacctctttgatgatatgcgataattttgcaacatgaactaaaagaagtaattatgaagtatcttttatctattgtactattggccttgattggtgttacaactccgaaaaagacaactcccgcttatgattggggaagtgtgtctgcaaagccggatttatcgtgggccgatcaggtgggggcgcagaggactccgaaaaacacagaatgggatgccggaaagttcgggttgcggaatgacacttccgtatttagtactcctgctatccaggccgctattgatgcttgtcaccaacagggaggaggcacggtagttgttgccccggggtattataaaataggtgctttgtttatcaagagtggtgtgaacctgcatcttagtaaaggtactaccttgcttgcgagtgataatattcaggactatccggaatttccttcccgcattgccggtatcgaaatgacatggccttcggctgttatcaatataatggatgcggaaaatgccgctcttacgggggaaggctttatcgattgccgcggaaaagtattctgggataaatattgggcgatgcgggaggaatatgagaagaagaatctgcgctggattgtggattatgattgcaagcgggtgaggggagtactggtttccaacagcaagcatatcacgttgaaagactttacgttggtgcgtacgggattctgggcttgtcagattttgtattcggatcattgttcggtgagcggacttactattaataataatgtaggaggtcacggaccaagtacggatggcattgatattgattcatccaccaatattctggtagaaaactgtgatgtggattgcaacgatgataatatttgtattaaggcagggcgtgacgcggatggactgcgtgtgaatcgtccgacggagaatgtggtggttcgtaactgtattgcccgtaaaggtgcgggcttgctgacttgcggaagtgagacttccggttctatccgcaatgtactggctcatgatctgatagcgtatggcacaggaacgacattgcgtctgaaatcatccatgaaccgtggcggaacggtcgagaatatctatatgacgcgtgttgaggctgatagtgtgactcatattctgtctgtcgatttgaactggaatccgaaatatagttattctgccttgccgaaagaatatgaaggaaaagatgttcctgaacactggactactatgttgactccggtagagccgaaggaaaaggggtatcctcattttcgtaatgtgtatttctctcacgtaaaagcagatggagcaaaacgttttatttccgcttcgggatggagcgcaagtcatcgcatcgagaatttttatctgtctaacattaatgcggaggtggaatctgtcggaaagataacttatggaaagaatttccagttacaggatattcatttgacggtaaaagataaaagccgattgcggcaaacggataatatagatagtaagattgagattaattacaaataattctccttacaggcaggaagctcttgacaaagccttttttatgttgtatatttgtaggtgtgaatatcaatggataaaaggtttgattaaaaagaatgaaaaagaaactagtacaatatgatgacaatatatcagggagtccttacagtagttaagctgtgagagtttctgtatgagccaaaggctgtgaatctttatgggatttgcagccttttttgttgcgaaaaatcacggttatatccttaattcggagattcatcgtttataataaacttggataccgtttataataaactcttcaatagtttattaagaacgttgacgaagattatgaaagaagagtcatcttttttctttttggttcaagataaattatgctttatcttggatatgttatgaaaagtaaatgatatagacgtcgttgtcacaaaactctattctttgcgtacgatattacagctcctatggtataaaaaacagtagctttgctgctacataatacttgatataccatgaaacgcattagccttcttcttttttttataggatgtttcctcttttctctttcggctacgaattattttgtggctactaatggaagcgattcaaacagtgggacgattgataagccttttgccacgttggacaaagcacaatcaaaagtgatggcaggagatactgtatatatccggcaaggtacatatcgagtgacggaagcagagataatggaacattatactgcgggaagtactacttggagccgggtatttaaaatgtcaaagagtggaactggaccggacaaacgaatttgttactccggttataaaaatgagcgtccggtttttgacctttcggcggtaaagccggaaaatgaacgtgttattgtgttttatgtaagtggctcttatttgcatttcagaaatatagaggtggtgggaacacaagtaactattgtgggacatacccagtccgaatgtttccgcaatgaagggggaagtgataatatctacgaacatctgtcgatgcatgacggtatggcgatcggtttctatatagtgacgggtaagaacaatctggtgctgaattgcgatgcctataataattatgatcctgtatccgatggcggtaaaggtggaaacgtcgacggattcggtggacatctcacttctccccaatatacaggcaatgtattccgggggtgtcgtgcgtggtataacagtgatgatggttttgatttgattaactgccaggcggtttttaccattgataactgttggtctttcttgaatggatatacgaaagacggtggtaaagctggtgatggcaccggatttaagtccggaggatatgggatgagtgataatcctaaagcaccaagtgtgattcctatgcacattgttcagtactgccttgcttatatgaataagaataaggggttttatgccaatcatcatttaggagggatagcgtggtataataatacgggttatcagaacccgtccaatttctgtatgttgaacaggaagactgcatcggaagcggttgacgtgccgggatatggtcatattataaagaataacttgtcgcatacaccaaagtcttcgggaaaacatatcatagacgttaatcaagcggaatgtgaaatagcaaacaactcttttcttccggtagatatggctgtgacggatgatgattttgttagtttggatgcttcccagcttgccttacctcgtaagtcagacggaagtcttccttatgtagaatttttgcggctgaagacgaatagtaaattatataatgccggaatgggttgttttcttgccgggggcagtgaagatactagctatgattggctggaagatgcggcaatacttgttgagggagatgtggcaaagatagtaggtcatggcgcagaagcatttgtgtacttctatattaatggtaaggcagtttctttctctgatagacaagtggatttatcggcctataagggagaaattgatttgaaagcgacgacagataatggtggcgtaactaaattgaaacagatcaggtgacgcagaaatatagaattatgaaaccgattcataaaataaagagaatatgaatagagaaacgataataaacagaccattggatatatttaggaaagcaatgcttttcctgctactttgtgttcttatcgcatcatgtagcaaggaagatactattacggaagaaactggtataaccggaactcctcatttcacctgggatattgcgatcgaacttgaacagcccaataactggtgcatgactttggctacagaaaaagtagcaataaccaatctaacagaaggaaaacaatatatactcacttggaaaggaggactttcaactgggcggaaaacaggaggggtattaaaaacggttatacgcggggaacaaacaaagaatacggatttggatctgctgaaaataaaagaatcaggaaatagtacttatgaaatctttcttcgtggtggcggacgtaaaggagagattgtgtttacaaaataatagtctaccggattgttcatcccggaataaatgatataagaaaaacttaactctatcgtagcgtgtcttcttttataaagaggatgcgcttttttgatactgtagagagcgttttattttaattcgatatatgtacaaaaataagtctgaatatggaatattgtatatagataaatagtatttgaatcctttgtatagaactccataagaaaatcaatatctccatatcttttgctttggggcaaatggaaacatgcggtacttttgcaaaaaagtaacgagatatagaaaatgataaagtcagcatttttaatagtagcgacatgttgcagtctgcaactgtttagtcaggaaaaatttcccgatggtaaaattataccggattggttttacaaaaatgaaaaaactgatataaatggattaggaaagagtctcttgattaccgactatggagtagtgaatgatagtacactgttacagacagagaaaattcaggctgttatagatttggcgtctaataatggaggcggagtcattgttatacctgaaggtacttatcttagtggtgcgctgttctttaagccgggaacacacttgcatttggaagagaaagctatattaaaaggtagtgacgatattagcaactttcctgtaatagaaacacgtatggagggacagaacctaaagtacttttcagctttgattaatgttgataaggtagatggtttcaccctttccggaaaaggaaaagttgatggaaacggtgaacgatattggaagtcattctggttgcggaggcgtgttattcctaaatgtactaatatggatgaattgcgtcctcgtctacttcatatatctcatagcaataatgtacaagtttcagatgtgcgacttgttaattctccgttttggacaactcacatttataagtgtgatagcgtaaaacttttgaatttgcatatcttttcaccttcttttcccgtaaaggctccaagtacggatgcaatcgatattgatgcgtgtaaaaatgtacttgtcaagggatgctatatgtcggttaatgatgacgcaattgcattaaaaggtggcaaaggaccatgggctgatcaagatcccgataatggtggcaattgtgatattatcattgaagactgtacttttggattctgtcacggagtgctgacttgcggtagtgaatcgatatataatcataatataattcttcgacgttgcaatctggatcaggctaaacgcctgttgtggttgaaaatgcgtccggatactccccaacaatataagtacatcctcgttgaagacataaaaggaaatgtccgcaattgtatctttattgctccttggacacagttttatgatttgaaagatcgcaaggatatgccagtctcgtattccagctatattacaatgcgtaatattcatctggattgtgattccttttttgctgtagagaaatcaaaacaatataaattatccaatttctgttttgacaatttgactattacggctaaaaaagatgtgaagatagatgaagatattattgatgcattggttatgagaaaggttgagataaataaagtgaattaaaaaagaatggtagaaagactggaaaatcgtacatagcctgtaaaatcgtacaaaataggcgtgtgatgggctgtacacgtatgaatttacataagaaagtcgaattctccatattccttttctttaactctaccatgtaatgcggtatctttgacatgtgcttattcagtaaaatattgaatctaaaactataaaatacaatgaaattctgtagaattattttttgtctgtggttattggtctgtttctttccaataggtattcatgcagatatacaacttccctctatattatcagataatatggtacttcagcaaaatgcgaaagtacgtttttggggaaaagcacgtcccggagaaaagattttggtaaagacttcatgggatcataagaaatacaaggtgactgctttagcaaacggtcattgggaactgatgatacaaacaccggctgctacttccggacaatctgtaatgttgaaaggtgataataagatccggatcaataatatattaataggtgaagtttggctttgtacgggacagtcaaatatggaatttcccgtagcccgtaatccgcaagtgaaatggaaaacaggaatgttgaatgaagcggaagaaatgaaagatgctgatttcccggaaatccgcctgtttcatgtagagcatcaactggcacctgatgatgaaaaagaagattgcgttggaaagtgggtggtttgtaatccggagaatctgaaagacttttctgctgtaggatttgtctttggacgtaaattgtataaagaattgagtacaccggttggattgattcagtctacttggggaggaacacatgctgaatcttggacaagtatgaaagtgatggaaaacaatccgctgtatgctgatgtcttaaaacaatattcaaaagaaaaggtgagtagggaaaaagataagtgtaaggttccggctactttgtggaatggcatgattgctcctatggtagggtacactgtaaaaggaaatatctggtatcagggagaatccaactctgttcgttatgagaaatatcaggaagtatttactaacctgattaatagttggcggaaagaatggaatcagccggatatgcctttctatttcgtacagattgcaccacattacaagcaaccggcaggtattcgtgaagcacaattaaaaacatggttaagtggacttgaaaatattggtatggcagtagtgacggatgcagccgattctaccgacatacatccacgaaataaagttgcaccgggcgaacggctggcagcttgggcattagcaaagcaatatggtaaaaagattgtttattcaggacctctctacaaatcaatgaaagtgaatgggagagaaattacattagattttgcatttgcggaaggtggcctgcagacacccggcaatgaaccggtaaaaggattttttattgccggcaatgatgcgcggttttatccggctgatgctgtgattaatggaagttcgataacactttcttcaacttatgtctctgcacctgtagctgtacgctacggttatgggactttctttagagtgaatctgtttaataaagctggacttccggcagttcctttccgtacggatacttttgctcccgacacttattatcgtctgtttgccgattcggaaattcgtcgtttcccggaagcgtggcaactggatcatggaaaacgcctgtattttggttatgcgcaaggagtaggttgttgtgcgatgttacaagtttggaagaaaacaggagaccgtaggtactttgattatgtagaggcatgggctgattctttggtagacgataaaggagagattcatttatataagaaagaaacctataatttggattatatcaattccggaaaagttctgtttgatttgtacaatgaaaccaaaaaggagaaatataaattggctatcgagaatttgatagatcagctaaaaaagcaacctcgtacaacagatggaggtttctggcataagaaaatataccctaatcagatgtggttggatggattgtatatggcttctccttttatggctagatatggagctgaatttaatcgtccggaatggattgatgaggctgttaaacagttcactctctgccatcagcatacatacgataccaagacgggactttattatcatgcatggaatgaggaccggagtcagcgctgggctgatccggaaacaggccattctcctaatttctggggacgtagtattggttggtggtttatggctttggtagatgctttggaatatattccccaagatcattcaggctatgctgatatgattaaatggacgaaggaattagcggagactctttcaaaataccaagataaaaatggcttatggtatcaggtgattgatcaaccttcacgtaccggtaatttcccggaagcttctgttacgacacaatgtatgtatgcttatatgaaagcagtgaataaaggatatattgatagtcagtatcgtgccattgcagaaaaggcctttaaaggtctgtgtgataaactactaatctcaaattcggacggaacattgacattgacaaaatgttgccaagtgggtggattaggtggtaagccttaccgtgacggcagtttcgagtattatataggagagaaaatgagagataatgatgctaaagcaacaggacctttcattatgggatgtattgagttgaacaaataatatagaagatagaaataataagagattttcgactattgtttcaattaatgaactaataaaatgtaataccatgaaaaaagaacaaattatcaaatcgatgttatttttaattattcctttgtttgctatctcatgtgatggtaatggttttatggaatatgaagagactgcattgatgcaaagagatgcgcagcaaggactgttaagtgatggggcaagtgataatatatgtatggttaatctgaacttattcacaaaaccttattttgattatcagtataatacaggtaaacatgtggatgaatgctttgtatatattgataatcaggaggatttaacagggcgtctttctttacgtggcgatgaaaatgtgaaatctaatattccaatatcttttgggaaacatcaaattaagttggatatacaaattgatggtggaaaatcatacacgtacccatttgagagatgcaatgcgttggtcactttaaagacaaagggttcaagtattgtacttttcaatgatgtcgtttctcaagagaaaggaggatctataacaaatgcttcttttgaagttaaatttgatgtagattttccttatgctgaaagcaatgactacgtactagatattacattaggattttatgatgaaacatatgatgacggctcttctggtccttatgtaaacggaaacgttagtgtgtatacttattatcaatggacagacattacatcggcacaaactgtttattgtgactttattcttggagttagatacaattctactcaaaaagagtattggtatagtaaagattttgagcaaaatctttttattgataagaatggaatgcttgttaataatgtaaattggcttgataaaacagttagattaccagatggtgatgatattggttataaattatttctgttaacggaaatttgggccaaactatactctagtattggcgttatgtctggcgaaacggaagtttcatggtattcagtttattatagaaacaaagaaaatgacggagaatattcagaatggtatccggctgacgaattagatacttccctagcatgggtagatgctaccattgatttttattcaaatctggagattgtatgttttaaaactaaagaaattcaagatgcttatgcatctcaatggggcattgtaccttataactaaaaagtcttgattttttataaaaaggtatggggccgtattatagctgaaagatgataaatttcatctaataatttttgggggaggaaatattaattcaaaattgtgaaacaacgtaattttagtgtaatcattaaataaaaatattgatggtagtttattatttaatttaattatatatgaaaaatattacattattaaaagcaaaagtaggaatattggcagtttcctgtctttccattactactttgtttgcatgtgttgataaggatgctagaagtgatttgagtcccaatttgccaacagatcaagcgcaaaatggggattttggtgatcaagggggaggttcggatcaggggcttaatttcccggtttttgatgatggagtacttgcttttcctggtgcggaaggatatgggaaaaatgtaacaggtgctcgtgcaggtgagggacgggaaatttatcatgtgactaatttgaatgatgcgggtcctggatcttttcgtgatgcagtaagcaaaccttggcgcattattgtctttgatgtatctggtgttataaaattgagtagcaatcctattgttttgaaaagtaatcagacaattttaggacatactgctccaggtgatgggattgttctttataatggacgtgtttctgcttcaggtgcacagaacttgattgttcgttacttgcgtatacgtatgggagctgcatatccttcggaactggatgcttgcggagtagctaatggagcagatatgatattcgaccattgctctatgacttggggaagagatgaatgtttttctatcaatcctgatggtaagggaactgccccaaagaatataacaatacaaaattctataatcgggcagggtttgcagaatcactcgtgtggtggcttaatgcaaactgatatatcgaatgggtgtacaatcttccgcaatttatatattgacaataaaactcgaaatccgaaagttaaaggattaaaccagtttgttaacaacgttgtgtataattggggaagtggagctgcttataatatgggtggtgattcttcaggtaaatcggaaacaactattgaaaataactattttatagttggtccctgtaataattggcaaaatgtggaaattgcacctaaagtatatgaggcgcaacaggtaccaatgaatcctgcaagaccatttactggtggtaacagtgattttagaagttattgtaaaggtaactattatgactatgacaaggatggagcattgaatggaatagagataacagaagtgaattggtcacaatattgtagtggctctcctacacttcttgaagctcgttctgatctacatccaattatacgcagtcagaaaagtgcacaggaagcttatgaatgggtagttgaaaaagtgggtgcttatcttccggtacgtgatgaagtagataaatacttgatagatgaacttacttcgttgggaggaaaaggaacgattattcaagatgaacgtaaaacagaacaatttccgttgggaggtcctggtacaataaatgctgcacagaaacctctggattcagataatgatgggatgccggatgctttcgaagatgcatggggactggacaaatatgatccgacagatgcggtaaaagaggctaaaaatggctatttgaatatagaaaattatgccctttcgttggaatatcctgatgaatatgagtatgaacttaataagaataaacaataatcaatttgtgtaatatgaaaaacatgacatttacaacagtactactttgtatactgttcatgcctttctttatctcctcatgtacagataagatagatgaacattatgaagaacctgaatggttgaaaggtagtgcttgggaagtcctggaagatagagggaactactcgctatttttgcaggcagtagagttggcaggttttaagcctattatggagggaaaaagtatcctgactgtgatggctccggatgatacggctttttcggcctatttggagaagcacggctattccgacatcagtgaaataaatttggatgaattgaaaaaagtgattggttttcatctgctttattattcttacaataaaaataagttggtgaattttcgtccggaaggtgatttaataactgatgaggaaatgaataaaaatgcgggtctgtattataagtttcgtacacgtagtagtaatgttcctactatggaagtagaggcttctacgggtaaacgacgcatggtttatcatctggaccgttttattccggttttctcttaccgtttttgggatacaaaaaaattggatgcagcatctaattatacctatttttatcctaattccacatggaaagggacagggggattcaatgtttccaatgctgctgttagtgaatatgaaattttggcagataatggttatgtatatattgttgatcaggtaattgaacctttggaaaccatttatacccagttggaatcaaatgaaaattattcaatttttttcaacttatataatgaaaataccacttatacgtatgacgctaccttatctaaagattttggagcagccttgggggccgattcactttttattcatacacatggtacttctttgcctgctatagcagtagaatggtattcaacgaaatattcggatgtagccaataatgcttcaaaagcatatagtgtatttgcaccgtcagatgtggctatgaataatttctttgataattattgggaaaagggtggatatgaatctttggatgatgtagatgatttagcaatgaaatatatgttgaatcaatttatttataaagatggaattgcattccctgatgaaattacgagtggaaaagttaagaatatgtatgacatggtctttaacttcgatccttctaaggtgactgataaatcaatgtgtgtcaatggtgtcttttatggattaaatacaatggatacacctattttgtttgcttctgtagtcggaccggctttccgtaacaaagattgtaattattatctttacatgttggatgggactggactgataactgcctattcttcacaagatacgaagtatgtcttgttagtgcctactaatgaacaaatagagtcagaagatatttacttgagaacttatgcggatggaagtaagttacaacaagaaaccgaggatggattggtagatgtttcttcttctgtaatgagaactattgtaaacatacatacggctacaggtgtagatggactgaaaacaaatgggacacaggttctagctacacaaaccggttttaattattggtatgtgaaggacgggaagataacaagtagtgcagcttataatcaaattttggaaccggataataatgtggaacctttctctgaatttacagaagtaaagaacggcaatgacaactggaataatggaagaacttatatgtatagtggaacagccttgtttcaagcgcaagaaggtgatgggttacaacataaattaagcgtttgtaatgataatcgttatgtttactatcagtttgcacagctgttgcagaaagctgatatggtaatgtctagcaactatatattcggactagcaggagcttctcatgttataggttttattccgacaaatgaagccattagtacagcaatagctgcagggcaaattccgggcatggatgcgaccggagcggtaactagtagttcgaaacttcgtcaatacctgctttcatattttatacgtgatagggaaaatgcacttatttcttatccttatccggggtcggctatgaagagttctacatatgttactgctagtggaaagtctttgacgtatacagattccggaagttcattaagcataatggtagatggaaaagtggcaaacgtgatatctgattataatttcttcccgtttgcgtttgacgacggatgttttcagttgattgatacagtcctttgatataaccgaatttaatatgaatatgaaattagtaaaatacatgctgatagcgatacttgttctggggacaggggaagtagccgcacaggtacaagtcgtgtccggtaaggtgaccgaaatgctgggaaatcagatcgaaccgatagtaggtgcgaatgtgaatattgtgaacgctcaaaaccgttctgtaggaggtgcggtgaccaatttggatggtgactaccgtttacaaattcctgcacaagaaaacaatctgacattggtatattcatacattggtatgaaaacgaaacgaatcaaatatactggtcagaaggtattgaatgtaaaactggaatccaatgtggaaacattggatgaggttgctatcactgctaaacgtatcgaacgtaataatatgggtatcggacataaagagaatgtatctgcgacccagaaagtgatgatggaagatttgattgctactgctccgatagctacggtagaagaagctttacaggggcagttgagtggtgtagatattgcattgagtgctgatccgggagcgcggagttctatccgtattcgtggtaccagtacactgaatggctctgtcgaaccattaattgtgattgacggggttccctatacacaagagttagatgacgactttgatttttctactgccaatgaagaagatttaggtgctttattgaatattgctcctactgatatagaatcggtagaagttttgaaagatgcggctgctacggctatttggggaacgaaaggtgctaacggtgtgttgtcaattacgactaaaaaaggtaagactggcaagactacatttaatttttcttctaagttcacagcaaaatttgaaccgaatagtattccaatgttaaatggatcggagtacattgctatggtacaggaggctttgtggaatagtgctaattatacaggtttgaatgcagatacttatttaaagtatttgtatgatacacctgaaattaactactcgcccaattggaactatttcaatgaatataatgtagatacaaactggttggacgaggtacgtcagaatgcatttactacagacaatacattttctatgagcggtggtggtgaaaaggccacttatcgtctgtcactgggatatttaagtgaaggaggtacaaccatcggtacagggctgaaacgtttcaactcatctttgcgtgtagactataatttctcggataagttgaggtttggagcagatttctactttacacagtcagataaggatgataactgggcaccaaaagatagcaacgtacgttcggaagcgtttaaaaagatgccaaataaatctccttattatatggatgataatggaaaccgttcttcacagtatttttcttatcagacaaaggattgggaaggtgaatttaaggcaagtaacaatagtgcctctcattttaatccggtagctatggcaaacgagagttataaaaatactatgtcacgtgatagccgtgctaatttccgtattgattataaaatacttccgtatctgacgtattcggcttatgcttctcttaagatgtcgactactacaacagacaaattccttcctcaagttgctacgggagtggcttggacaagtgaatatgccaaccaaagtactgctgcttcttcagagagtctaacgttgcaaacggaaaacaaattgatattcaataaaaactggaaggataaacataatttgattgcaactgctgtattccgtactacgcaggctaccagttctagtgctacaagtacttcttatggtaatgcttcatctggtcttgcagatccgattacaggtagttctgtttatagtctgggttcaggggagtcggaagcacgtagtatttccggaaccggtttgattaactatactttgttggatcgttatgtatttcatacttctgcaacgatggatgctaattctgcaatgggtaagtcagaacgtttgggtatttttcctactgtgggaatttcttggaatatgcaaaatgaaccgttcatgaaaaatacagaagactggctggatgaaatcaaacttcgtttcagcatcggacaaagtggtaatgctcccaaagggacggccgcttattatggagcttatagttcacgaggagaatatatggatatgtctgctatttatcctagcagaatgcagttgaacaatttgaaatgggaaacttcaacagaatataatttgggtggtgattttagctttttccatggcaagttaaggctgacttttgagtggtataataaatatattaaagatttgctgcagaaagaaccgaaaatgccgactactacaggattctctaagaataaatggtacaactctggaagaatggagaataaaggatgggaggcccgtatcgatggtgtattgtatgaaaagaaagattggcgtgttagtgcctatgttaacttgagccgtaacacgaacgaaattaccgaactgcctgaaacaatgaatccggagccttatacctttaaaaatggtgagtatgctattcgcattgaagagggacgcccgtttggttctttctatggttatcgttacaaaggagtctaccaaaatcaggaggctacttatgcacgggataaagagggaaatgttatgaatgatgtgaacggtaaaccaattgttatgaagaatggtgctaagcaggtatgtccgggtgatgctatttatgaagatattaatcatgatggtgtgataaatgaatacgatattgtttatctgggcaactgtaatccgattcttactggtggttttggctttaccgttaaatataagcgtctaagtttgaatgcattattctatggtcgttttggacagaaaattattaatgcgactcgtatggataatgaatctatgtataatgccaataaccaaagtaaagcggttttgcggcgttggagaaatgaaggagataatacggatattccacgtgctttatataatgagggatataactatttagggtcagatcgttttgtagaagatgcttcttatgttcgtttaaagactttgtcgttgagctattccttgcctaaaaaggtgtgcaattatttaggtatcaatacgcttaatttctttgttactggttatgacttgttaacttggactggttacacaggacaggatccagaagcgtctcttcctacttcggcttctaaactgtcgaaagatagtgcaaatacaccttgctctcgccgtttttcttgtggtttaaatttgaatttctaatacatttacagacatgaagaaactgatttatatagggataatggcaggtagcctgctgctgaacagtagttgcagcgattggttggacttgcttcccaaaaatgaacaagtgactgacgcttactggaaatcgaaagaagatgtagaagcggtcattgcttccggttattattatatgcgttcctcctgccagtcattgctaaaatggggagaactgcgaggagcatctatttgtaccttgacaggtgataaggatggaatgaagttgcagaatttccagttggatggaacagaagctatttgtaaatgggagaacatgtatcaagtgatcaacatggccaatgtggtcatcgctcatgctccgggagtacgtgaaatagatgacacctatacagaaggtgcaatgaatgcacatctttccgaagcttatttcatgcgagcattaatgtatttttacttggtacgcaattttaaagaagtgcctttggtaacaactccttatgaggatgactctactccgttttctattgccaaatcttcagaagaagaaatcttgaagcaaattaaggcggatgtgcaaacagctcttgactctggaggtgcgaaggaattttatgataatgataattggaatgcttccaaaggacgggctactaaatgggctttgtatgcattaatgtcggaagtttccttgtggaccgaagattatgatacttgtattaagtatgcagacctattaatcaacgctactgcatcacgtcgtccggcatttattacaattccggagaactggtatacaatttttaatccggggaatagtaatgaatccatttttgaagtgaactgggatggcaacacctatagccagacgggagggccaagtgctatgtatacgactggtacaaatcccaattatcgatattctactaaaatgggtgaggatttggtcaatgattttgaagaggttatggcaggaaaagatgcaatccgtagccaatttggtgcttttatagcttatactgatggagagaacatcgttcattgtatatggaaatatgagatgggcgataccgacccaacgaatccggatgcaatacgtttgaaagatgatgctaactggattatttacagaatggcagatgtcatgttgatgaaggcggaagcattaatttggaaaggaaaggaaaattggcaggaggctgttgatattataaatcagatccgtactcgtgctaacttgcctgaaaaaactatagctttagatgaggaggatgaaagctcaatgatggaaaactatttattgccggaacgtaatattgaattggcggctgaaggtaagcgttggtatgacatgatacgttatgccaaaagtaagaactatgctcataaatcagcttttattgctttggttcagcaatacaatacaacagcgaatgctagttggatacgttcagttcttcagaatgaatatgcatggtatttaccaattcacgcggatgaaattgaaaataacaacttattggtacagaatccatattatggaataacaggtaataattaataaacagccatttatgaagactttaggaaatatatatttattattattggttgcattattcagtgcatgcaacgatccctatgaagactctacttatcaggtttatgatatgaatccggtatcgtcttatctggaaactcgttctgatgaattttccgagtggatcaccgtattgaagtatgcagatttgtttaatgccgtgaatcaggcttcgtcttattttacggtattggttcctacaaatgaagctgtgcgcagtttctatactaaaaagaatgtatcttctattcaggaattgggaaaagactatgcccgtagtcttgctgaatatcatatcgtgaatgattctatcaatctgaatacttttgttcaaggaggtaaactggaagctaaaactctttcggatgattatctttccgtttcttttgatgaaagttcggaggctggaggatttaattcaatttatgtgaataaagaagcgcatgtaaaggaactggctatccaagtgtctaatggatatgtgtatgtattgaatgatgtgatgtctcctttggtggaaagcctatatgaacgtatcagtgaaagtagtaataaatactccatttttgttgatgctttggaacaaacaagttggaaagacagtttgagtactatttacgatgaaataaggcaggaagataatacggttattcagcaaaaacggaattatacgttgctggctgtatcagatgatacctatcgttctgaaggagttacttctgttgctgatctggctgctaaagtaggtgcaataggaacagactataaagataaagcaaacgaattatttcgctatgtggcatatcatgtgattggtggaagttactctgtttttgatttcaacaattttagtggaggtgcaactacacgattgtggactaccaaagcagatgcagtattggaagcatctatgcagagtggcaataagttgtattttaattataaaggagaaattgatggtcaatcggtgaaagcgatgtttgttgaagacggttccgatgtacaggctaaaaatggtattttacatgaaatagatagctggttgcctttgtgggaatccgagattccggtgcgcgtagaatgggactttgctgattatgaggaggtagcttcttgggtgaatggtggttatggtgatccggaccaaaagtatcagacggcagatgaaaaagagcgccagtcggatgtctcttcgctctcttgttacaccgtagatgccaggagcactcttacatctctagatggtcaaaacggcggatattatcgcgtgggctatgcaactccgaagacaaaaggctcggactggatcaattgtaaaaatacagatcatatctatttgaatttgggatataatggttccgttaccatgaaaacaccaattctgatagctggcaaatataaagtgacgttgaaagttacttatgcaaaatcaatggattttatgcgtacaatgactagtggaagtaatggaggtaaaattaagtttacatttgatgatgacaccgatacagatgtcgaagttcctatttatgcgagtattacagccaatgaattaggacgttatgatgtagttatttatgatgagattgaattctcaaagacgaaggttcattctatgaagatgttggttgccgatccggctgcttcttctcataacaagttccgtatccaattagattatatgacttttgaaccgataattgaagatgaatagacacatacttatgaaaactataaaatatatattgtcatctatattgctgataagtggtatatatgcatgtaatgatgactgggattctcattattcccaggaagaacaggtagtgaataatgtaaatattacagtagtcaacaagtcggctgttgattatttacagtcgcaaccggaattgagttccatgtaccaattgttcagtgaaacaggagtgctggatgaaatggttgagaagaatttgttgttcactattttagtggttagtgacgagaatgcattatctcgtgcagttgctacagatgatagaacttttttggctaaatcacacatttcggatatttctctttctccgtctaatctgtcggatggacaacgtgtgttgatgtggaatggaaaatatattaatgtgtcgaaggtagaaaatgaagataatgatacttctatctcgttcaacggtatagctgtgaaaaagataacgaaggtgaacaatggctatgtttatgaaatggaggattatgtggaaactcctaaatcattatatgagttgattgaagggttaggagatgattattctatttttagggagatgattatggagcgtaatcagttgacatttgataaagaggccagtaaaattataggtgtcgatgaaaccggaagtaacgtctatgattctattttcacggttactaatccttattttgaggctgaaggttttaatatgatgtcagagtcattatcagcgactgtattgattccttctaatgaagttgtcaatcgtgcgttggctacagcccgtaacaaaatacaggaatggggaatgcaacgggaggactctattctgaaaaactggacttttcaatcaatgttctttaataaaaaacttactaaatcggattttgaagataatatagacttgaattctatttttagtaaacagtggcgaactacagtacaagaggtggatttggagaatcctgtatctcttagtaatggtgttgcatattatgtgaaagaactgaagattcctactaatgtattgatttatcgtgtcaaagattttatgagatggtatgagtatctgtcagaagaagaaaaaacgctttattttgatagcgaaaatctaacttttgataaaatggatacgaaagtgacagcatggtcaggttggcctggtgttttcccaactataatcaatcgcgtcgtacgttttaaattaacagattctgctactaaagagtacacattggattttacaggttttagttatgatgaagtaactagagtcgctgctccgtataagatacctcctggtgaatatgatttgtgtttgggatttgagcaaaaaatgggacatgacgtggaagtttcttttaatggagagtatgtaggaacagttacagcctctcaactgacgaagactgattggcactatgatcgtggcggacagggatatcctgaagggtatgacacttctaaagcgacagataaaaataaaacaaagtacgatcgtgatggagcaaaagttggtgtagtcactattggaggcactcaaccggtaaatgtggttattaaattccatggaataaacgcaagcaaatgttgcttccaccactggtgtctgagaccaacaaagaactgttattaattttgataaggaatcaatatgaagacaataaaaatcatatttacaactttgctgttattactgtcggttgccagtgtatatgcgcaaggacgtaaaattagcggtaaaatactttcaccgctgaataaaccgattgaaggggctatcatttcggctgtaggaagtaaagatgcgaaaaccggagttgacggaactttcaaaatggagttgaaagagaatacgactcaaatttcagtgtgggcagctggttattatccggaaactcgcttggtagatgataattcacaagtggttattctgatgatgccggagagcacatataaatataatgaatcggctgtattacctatgagaatcgaaagttcccgtccggaactgacttctgcggtgaatatcaataaaaaagatttcacgcagggaagtatgaagatagatcgggctttggcaggacaggtagcaggcttgaagaccacccgtgcaggtggtatgccaggtgaaggaagttatatgaacttgcgtggtattcgttcttttgtaggttcaaatgctccgcttgtggtaattaacggtgtaccctatttacctgattctcgtgaatcacaattgataaatggattttcgagagatatatttcaggcatataatattcaagatattcaaaatatcactgtactaaaaggagcggaggcttctatgtatggttcgatggggtcgaatggtgttattctaattgaaacagatggtgcaacttccgataatttggatacgcgggtcagcttttatgggcagtatggggtgaattggaataataaacgtatgccattacttacaggtaatgattacaaatcttacctttcggatattggtatgacttatttcggtaatatggaaggatttttctcggaatttccttttttgagtgatcccaatagtaaatacaattacttgtataacaataccacagattggcaagatgaaatttataaaaatggttttgtaacagacaacctgtttcgtgtagaaggtggtgatgctattgccaaatatgacctttcattaggatatgcgctggaaaatggactgatggattacactaaaagccagcgttaccatacacaattgaatacaaatgttttgattagtaaatgggtggagatgacagcaacggtcggtttagcttatctgacaggcaattatcagcaacagggaatggataatgttagcaatccgatcttagcagcttattcacgtgctccgttgttaagtccttataagaaagataatgatggtaatattttggatacttactctacttattactatggcaattcaacgaatatggattttgcagtcagtaatcctttagctatcgtcaatacacttgatggtcgtaaccgacagtatgatgtaaatttcagacttggattggtttacaagcctttcaatggattatcgttcaatggtacatttggaatgttttataattataataaagaacacctatttattcccggactatcagataagagtattttgccgattgtcgatcagtatggtaatgcagaaaataccgtgaaggaaggtgtaggtgaaactttgaacattttcgcaaatggtaatgtacgttatcagagactttttcaaggtatccaccatttgaatattcttgctggtgctcaaatgttgattactcaaaataagtatgaaggtggtgcaggccgtaacactccgaatgatttttatcaaacattgggagatacaaaaacaatcggacgctacttttacggttatcaggaaaaatggaactgggcgaatttttatgctcatgctgattatacctatcgtgatatggtagcagcttctttgaatgtggcggctgatggtgcgtcctctgccggtacttatggaaaccacttttatatatatccttccggtggtgtgactttgctcggaaaaggttggttgccattgactaactctacattagtaaatcgcttaaacttgcgtgcggaatatggtttgtccggtaacagccgtttctcttccaatcttggaaaatattattatacaagtttaccttatatgactacttccggtattgttcgtgccaatatatcaaacaccactttgaaaccggagaagaacatacaattcaatctaggattggatatgagtctgttgcgtaaccgtttggaagtgacattggattattataataatctgtccaaagatgtcatttttgcagtacctcatacatcggcacttggttctctaaactattatgcaaattgtggagaaataaaaaatagaggtgtagaactggcagtgcaagcttctttggttcgtacacgtgatttcgaatggattataggtggtaatattgcccgcaatgaatcggaggtggagtcattaggaaacacatcacaattgattaatagctatagtgatggtgcgcagttggtttcccgtgtaggagagtctccttatcagttctatggttatcagacgcttggggtattctctacacaggctgaagcagatgctgctaatctggtcaatcaaaaaggacaggcttatcaggcaggagacatccattttgtagatcagaacggtgatgggcgtatcgatagtaaagatcgtgtctctttaggcagtgccgcaccgaagtatttcggtggcttttttacacgaatcagttataaatcttttgcattgtctgcagaattctcttattcaaaagggaatcaggcttataatggtgtgagacgtagtttggaatcactttctacttttggcaatcaaagtgcggcagttgtaaaccgctggtcgttggaaggacaacaaactaatattcctcgtgctcaatggaacgacccgatgggtaacaatgacttttcggaccgttggatagaagatgcttctttcttgcgtatgaagaatgttacatttagttatagttttgataagaaattcttgaatttcttccgttccggtacattgtatgtaacaggtgagaatctgttgacagctacaaaatatttagggttggatcctgaattctcttattcttatagtgatgctatgcaaggatttgactatgcgaaaatgatgcagcctaaatcaattaaatttggtgttaatttgaacttttaaggatgatgaaaaagaatatattgaaatatgtgttactaagtatgacattcttcttaggcgcatgcaacgatttcttcaatgtcgagacgaagaatgtattagatcatgacggatacatcaccgaagaaagtgagatgtattcggggtatataggtattatgaccaaagtacaagccattggagacaaagtgatctatttgacagatacacgtggtgaattgctggaaccaactaagaacgctcctagtgagttgtatagtatctataattatgatacagacctgacaggaaattcgtatgccgatccggctgcttattacgatgtaattatagcatgcaatgactacttgtcaaagttgtatgattataaaacagaaaatccggcagctattaatctggatcattataaagctttggttagttgtacacttcgtgtgaaagcgtggatatatcttacattaggtaagatttatggagaggctgtctggtttaatgaaccgattcgtgagatgaaagatttgaatgactttcctgtgaaaaatttggatgagatagtggaaggctgccttgatttattaactaaagggtttgatggaatagatggcacgaatacaatgtcatggaaagaatggctcgatcctgatacggaaacagcagaaagtacatatcgttattgggactatatgacaccagaattctttgcattatatggagagttatgtttgtggcatggtgactaccagaaaacagtgaatgttattttgaatacaatgaatgcaaagtttgccagtacggtgaatgatgcaacacagtatatgcataatgtgaagttgacaggtacatatagtaagatttgggataatactaatcctcaaccacaagagactgtttctgctattatctataattatcaaggaaaccaaactaatagtttgttgaaacattttgggacagaatcacccaatgagtatctgttggctccgtcacaggtaggaatggatcgttatactgatccggattttaatccgcttggaggtgctacttcggataagcgttctacttattattttgcgaaagataaaagtggtaattatgttatccaaaagtatcgtccgtcaaatagcacagcgcgtacctatgcttatcaagatgatgtgcatatttatatttatcgtggcagtgagctgtatttcatgttggcggaggctctcaataatttgggacgtgtaacggaagcatcggcattgattaatcagggagtgaatggaagttttccgaatggtggagtgacatgggatggttttacagatgactggaccggagctagtacgttaggtactcgtcgttatccggacctgggtattcgtggggcgtttaacttaggtaatcgtgagtttacacgtggagatgctagagctaatgatgaagcgattcttgatgaaatgatgcttgagtttccggcagaaggaaagatttatcctactatgattcgtatggcacgtcgctacaatgatccaagtattatagctgatcgtgtttgtccgaaatatgctgatccggaagctattcgtgctaagattaatgcagaagttggtggaaaagcaggttatttcgttcattggaatttaaaataaagatcctcaaatcatcctttggtttggattattagggtggagtgacgcgggtttttgaatgagaatccgcgtcatttgtttcaaaaataaatacttttgtaaataacaataataaagaaaaatgaaaacattcgcagtatctattgcagcactttttatttggacagcttgcggagatggaaatcagccgataattgaccgcgaggcattagtagaaaggaatagtcctgttgtgacggcattcgattcattagcttcactttctgtaggaaatggagaatttgcttatacggtagacataaccggattacagacgtttccggacaattataaaaaaggagttccattgggaacgcagagccagtggggctggcatagcttcgccaatccggaccggcttactccggaagaaaccctgaaagaatacgattttggcaggggaaagaaagaactttacgctactcaattcaaagaagaaggcagacaacaggatgccgctaattggtttcgtgtcaatccgcatcgtcttcatttaggaattgtcggctttgacgtggaagaaggtacggatattggacaggtaactgacgttcatcagaaactttgcttgtgggatggaaaaatcgaaagtcggtttaaattaaacggtgaagattatcaagtggagacagtctgtcatccttctaatgatatgattgctgcaaatattacctctaaggcgcataccgggatttgttttcgctttccgtatcctacgggcgctcattgtgatgatgcatgtaattgggaagccgttgataaacatacaacgactattgttactcaaaatgaatcttccgcagttttgaaacatactttagatagcacagagtatttcgtaattttgtattgggaagggaaggctactttcaatgagaaagcaaaacattattttgtcctgactccgatggacgatcatttagcttttacatgtgcttttactagtacagctccttcaacgcagcctgttactgtagcacaaactcaagaagaagcaaaaaactattggaactcgttttggaaggaaggcgcagctgttgacttttcggcatgtacagacccacgggccaaagaactggaacggcgtgtgatacttagccaatatttgcttgctattcagagtgcaggtactactcctccgcaagagacggggcttacctataattcgtggtttggcaaatttcatcttgaaatgatctggtggcacgaagctcaatttgctctttggaatcgtagcaacttacttgaccgtacattaggttggtatgaaaaggctgaaccgatagcgcgtcaaatagcccaaagacaagggtttgatggtgttcgctggatgaaaatgaccgatccttcaggaacagaagccccttccaaagtaggaagttttctgatttggcaacaacctcatttaatttatttggcagaattactttatcgtgctgatccgactaaagaagtattggagaaatataatcgtttggtacaggagactgcagaatttatgtactcttttgctacatacgatgaactggaaggacgttacgtattgaaaggtgccattcctgcacaagaaacgttgcgtgctgcagaaacagttaatcctcctttcgaactttcttactggcattttgccatgcagaccgcccaacaatggcgtgagcgtatgggacagcaacgtagtctggaatgggatgaaatgatcgacaaactttctcctttggcatctaataaagaagggctttatctggctgccgaaacagctacagatacctataaagacattcgttatacttccgaccacatggctgtattaggtgcagttggtatacttccgatgaataaacttatccgggaagattatatgaaaaatacattgcactggatctgggataactggaattggggtaaaacctggggatgggattatccgatgacggctatgaatgctgcccgtttgggtgaaccggaaaaggccgtcggagctttactgatggataaacgcacaaacacatacttgccgaatggtcataattatcaggacggtcgtttacgtatttatttaccgggtaatggcggcttgctgactgctattgcgatgatgtgtgccggttgggacggatgtacggagactaatccgggatttccgaaagatggaacttggaatgtccgttgggaaggattgaagccattaccataatcaaacacaaaaaaatatgagttattttcatctgaatcttattttaaaaggaaagctgactgtttgttgcctcttgatgttgtcggtgataccattaaatgctcaaagagaggcaaagcagatcggtgactttaaagaatccatctccttgaatgaacatctgcgaggtacaaaaaggacgttgcaatattgtcccgatggtgatgagtttgtttgtgtcaatggtaagaatcggtatacccgtgctttgtacggtagtcacagtccttttcgtgtagaaacaagtgaccgaccggtttttgctttttataataacggacgcggaggaaatataagtttcaaagtcattcttcgtgacggaacagaattggcgcttgatcgcaccgggtattgtgaatcccgttattcggctggaaaacgtacctattatttgacagacccgtcttggggaaaaggagaactgcgtatttcagtattggcattagccgatatggatggagctatttggcgtttttctccttcgaatatgcctaaaggagctatacttcgttggcaacatgggggagctaccggaaaacgtttgagtcgtaatggagatatgggggtagatccggctgattgcttcgaacttcctgccgaagcgactgaccttgtcacaggtgaacttgctttgcagaaagaagtatacttggtacgtggggaggttcccgaaggctataatgtccgtaaactctatcaacaagcggaggcagcctctttggcgttggcttctcatttgaagatagaaacgccggacccttatttgaacacgttgggtggtgcattggtcgcagctgccgatggaatttgggacggacaggtttggttgcacggtgctattggctggcgtatgccgttaagtgggtggagagccggatatactggtgatgccttaggttggcatgaccgggcacggactcattttgatgcttatgcagccagtcaggtgactgatgtcccgaatacaatacctcatccggcacaggattctacaatgaatctggcgcgttcggaaaaacgttggggaactcctcaatatagtaatgggtatatttgccggaatcctgaacgtaacaaccagatgcaccactatgacatgaatctttgttacatggatgaattgttatggcacttcaactggacgggagatactgcgtatgtccgcaaaatgtggcctatgattacccgccatctagcttgggaaaaattaaattatgatccggacaatgatggtttatatgatgcatacgcttgtatttgggcaagtgatgcgctttactacaacagtggcgcagtcacccattcgtcggcttataactaccgtgccaataaaatggcagcttttcttgcttctttgataggcgaagacccttcaccttatcagaacgaagccgagcaaatattgaaagcgatgaataagcgtctttggatgcagggcaaaggttgttgggcggaatatcaggattttatgggacatcgccggcttcacgaaagtccgggattatggactatataccatgcactcgatagcgacgttgccgatccttttcaagcttatcaggctacacggtatgttgatacggaaataccacatatccccgtgtatgccgatggactggaagaggggtatgcaacgattgccactaccaattggttaccttattcctggagtatcaataatgtggctttcgcagaggtgatgcatacagctttggcctatttccaggcaggacgtccggaggaagcatatcgattgatgaaaagttcatttctggatggtatgtacttaggtaacagtcccggcaatttggggcaagtcagcttttatgatgctgcccgtggagagtgttatcgtgactttggagatccgataggggtagcttcccgattactggtacaggggttgtatggcattttacccgatgtattgaacgggaagatggtgattcgtccgggatttcctgcaggatggtcaaaagcttctatttctttgcctgacataacctatcactttgtcagggagaatgatacagatatttaccggatagagcaacgttttaaggcacctttggcattgacattacaagtgaatgtcggaagagaaaggattcattctgtgaaagtaaatgggaaagaagttgactggagctttgcggaagctgcttccggttatccggtggttgttattcctgcttcttctgcccaaaaagcaattgtcgaaattgtgtggggaggaaacagactgaatccggttctgcctgaaatacaggcggaggctttagtggagatccgtattccatccattttaggggcggtattcggtgaaatatatgatccgcagggagtgctgatacaaccgaatgttagtaatacatctataagaagtaaggtcaatgatcatttggggcatcatacattctttgttcgcatgaaacaaggacagatggaatggtggcagcctgtaaacgtacagattacgaaatcggaaaaatcaccggtcattcttcctttctcacaggtgaatacgtcagagtgccggatgatgaatatggattctttgttcaatgcgaatgtgactgatattttccggaatgagtatctgacaccccgttcgccttataccactttgcaacttcctgttcagggcattggcgagtggtgtcatccgaaattaactgctgatattgatgatgcaggtttgcgtgccttggtacgtgatgagatgctgactaccaaactgggtgtgccgttccgaacattggctcaaggaagcaatattgcttttacttcgttgtgggataattatcccgacagtttgagtattccgctttccggtcgggcttctcatgcctatttaatgatggcaggcagtaccaaccacatgcagtgtcgcattgctaatggtattgttcgtgtatactatacagatggaacttctgatgtattggaattagtgaatccggataactggtgtcctattgagcaagatttctatgttgatggtcaggcattcaccgttgtttctccccgtccttatcgcattcattttaagacgggtttggttagcaatgacttgggaaagaacttaggcataaagggtgtttatggacgttccatcgagggaggagcaggtgtacttttggacatgcctctgaatccttccaaagagttaagtcatctgacgttggaaacactttcaaacgatgttgttatcggtttgatgggagttacattgcaataaaataaaaataacatattaataaaaggataagaattatgatgagaagaactattaatttactactgatgttgctttttgtggcagaggtaacatctgcgaatactgttgattttgataaagcatttaaagaaagcgcccgtatcgaaaaacagattaaacggacctctttcccgaaacgaacatttcttataactgattttggagcaaaaacggatgatgaggctaatccttgccatgaagccattaatcaggctattctacagtgcagtctgtcaggaggtggcacggtaattgttcctaaaggtactttttataccggacctattactctaaagagcaatgtgaatttccatctcgaagagggagctgttttgaaattctctacagatcaaagcctttattttcctgctgttttaacccgttgggaaggaattgattgctataatgctcaccccttgatttatgcttatggtgaaagcaatattgccataaccggaaaagggattatcgatggacaaggtagtatggaaacttggtggccgatgtgtggagccgtaaagtatggttggaaagaaggcatggtggctcaacgcaatggaggtcgtgaacgtctgttgatgtatggtgaaacatcgactcctgtctacaagcgtctgatgaagccggaagatggtatgcgtccgcagctattgaacttacattcctgccacaccatcttgattgaaggtgttactttgttaaactctccattttgggtgattcatcctcttttctgcgagagcttgattgttagcggagtgactgttttcaatcgtggacctaacggagacggatgtgatcctgaatcttgtaagaatgtgttgattgagaattgtacatttgacacgggtgatgattgtattgccattaaatcaggacgtaatgaagacgggcgtaaatggaatattcccagtgagaacattatcgtacgtggttgcatgatgagaaatggacatggaggagtagtgatcggcagtgagatttccggtggttaccgtaacttgtttgtagaagactgccgaatggatagcccgaatctggatcgtgtcattcgtattaagacgagcacttgtcgcggaggacttatagaaaatgtatttgttcgtaatgtaacggtaggacaatgtcgtgaagcagtgctgcgcatcaacttgcaatatgagaatcgggaaaaatgtaagagaggttttgacccgattgttcgtaatgtgcatttgaaaaatgtgacttgtgagaagagtaaattaggtgtgcttattatcggattggaggatgataaacatgtatataacatcagtgtagaggattctcattttaataatgtagccaaaggagcaaatgatattaaaggggcaaaagatgttacttttaagaacctttatatcaatggtgaattggtgaaatagggtataattgtagtaatttagaatatccgaatatgaatgaaaaagaagatttagaagaactccaatgttttgtttcaaatatacagaatgattggaaaacagcttatgatgcacaaatttatatcacatctctgtctgtaataagtaatcatgattggaataaattagaactttggataaatcttcatcaggatggttttatctataagttaagacattattatcctgcactttcggaagacgatatacatatcattcttttattacgtattgattttaataatgctcaaatttcagagttgtttcatgttttagagagttcttttagaatacggcgtagtagattgaagaaaaaaatgaatgttgcttgtgaatctattacagattttgtcaaatcattgtatttagaataattctcttttttatagtaaaaccatatataaatgtgtgtataagtaaatgtatacgcatttgtatatggttaatatttttctcttaacttagaaatgtattcttttgcaacaaattatcattgaaaaacatttttcattcatactaatattatggaaaaatacagattatcatcgtatgcaatatcgatagaattagaaagtgaacctgacgatagcctattaatacatggctataccggtgctatagatttaatagataagtccatagtaaggtttctgatagaaaatccttattttgatagggctgtgctaccttgtgaagaaagtacaaaagatactcttgaaaaaagaggatatatcactttacaaacagaagatgaagaaaaagaatactttaaacgtttagcaacagcactttttagaaaagaaagtatgctacgtaaaggttttacttttctaattacctatgattgtaactttcgttgtccttattgctttgaaaaagatattcagaaagatggaacagcgttcaccaaagagatggtagataaagcctatcaagctatattacagatagcaccagacgaaagactacgctcaaggtcaataaccttgtatggcggtgagcctttattaaagagaaataagaatattatatcttatattattgaacagggtaaagaattaggatttaagttttctgctatctctaatggttatgacctgaaatattatgaagatcttctctcgccggaagatattagctttattcagataacgatagacggcattagagaacgtcataatcaacgtcgtattcattatcaaggataccctacatttgatacgattgtagaaaatattggaattgctttgaataaaggagttgctatttcagttagagtgaatgctgatcgaaacaatatagaagatttagagggattacaaacgattttttgtgatttgggctatacagagaaccctttattttctataaactctgcattattaagaaattattccgatagtacagaaaaagcctatcaatacttctcacagaaagattttatagaatggcataaaaaacatggcttggaatctacttgccaagattatggagtatatcgtagaattcatgcagcgataaaacaaggtaaacctctatcttttcgttctactttttgtagtgctcaaacgggtggatttgtgtttgatccatttggtagaatttatacatgctgggagactgtgaatcaaaaagaacattgtataggtaattattctttgaataatgatattgtttggaatgagcaagtcgaagaacgttggagaaagacctatcttttggagaatgctatatgcgcaagctgtaaatacgcattactgtgtggcggtggatgtccggcacaaaacttacagaaacatcgttgtacgcatatggaggatatagttcataatgctgcgaataaggcttatttaagcattaaataaaatattaattaaaatttatttttatggaacaaaatgagaaaaaagaactacgttctttgaatgtagagttgccaactctttatgttgaagaattggaacagcggttagaaaccgatccgttggctatcggtggattactatctggagattttgatggagttgaagcatattcttgtggtaaagattgcgatgaatttacttgtgacgttcattgcgatgaccattgttcagagcattgtggaagatttcattgttcggtagattaggtaattccgtaatgaattaaagctaattattgaatctattttcagtatattctctcaattgatttgagagagtatactgatatgtaacttctatttttattttatatagaatgaaaaataatgtatttttagtttgtatgttactcttttctatatctgtttttggacaggaactgaaaattcaggggcatctgatagatgaagagaaacaagacttagtggctgcaactatacgctgctatctgaatgacacgctttttgtggtagggggaactacgaatagtaaaggagaatttgaactcaaacttccacatacggaacaaaagtacaagctattaatcagttatttaggttataaagaaactactttagtattgaatccgaccaaagagaccctgattcgtttaggagaaataacgatggataagaaagtggtacagatgcaggaagtaactgtgctagctcccaatcggataaataccgaagacaaaataatggcattccctactcgcgagcagttacgacactcttatgacggatacagtgctttgcgtgcgttaatgattccggggctggaagctgaccctcgaagtgcaactatcacttatcatagagaaaacgtattattgtgtattgacggacgtgaggcaacacgggaagaagtgcagaatctaaacccaaaagatattaaacgtgtagatttttattctcaaggtcgttccgattacccggaagcttctactatattagattatatacttaaagaacgggattacttaggaacaatcgctttaaacgcaaggcatcaattgaacaaaccaacaggcactggacgaggaactgcccagtattttgaaggaaaatctgaatgggctgtatcagtatcggacaattatactcattttagaaatcatgacgaaggatataccgaaacaatttatcattttcctgacgaaaccatcatccggacagacgatgaattgccctcattaaacaataataataacctgaaagcttatctaaattatatatataaagataagttgcaaacattttactcttctttacggatgaataggagtatgtctgaaaatgacaactggaatcggcaacggtataataatacatccgctgttctcgtgaaacaagaatacaaacatactgttaggttgaatccggctttacaattacgctataatcgtactcttcccaaaaggcagatacttcgattggagttgtatggaagttatggaaacaacgattacaatcgatggtatgagcagcgtacggatgaagtcataacgtcttcttatgccaatgctactgccgaaggtagttggtatggaagacttaattgtaactatagtaaaagtttcaaaaataaatcatctgtcagtttgactctaaatcagaattttacgcatactaacaacttaaatacaaaagaggggcaaaattcagagatctttttaaataaaggtaataccagtttttatgctacatataattatcgcattaagaagaaatttaatctacaagctagcattgccgaacatttatcatatactacgacgaatggaaatcatgtgttcagttctttcttcataccttcattgaaactctcctatcttcataagggacattcgttgaagttgaccggaactgtccgtagtacagaaataagtctttcaaatcgtaccggttacgaatataaaaaaaatgaatacgagatgtttgtaggaaatcctaaattaaaagactatttgcaatataatgcaggattaaattatgattggactatgaattccaggtggacattgctttcttatgctagtttgcacataagtaatccgcagaactatgaactatatcgttatgatgacgaacggaaaatgtttgtatatcaaaatttgaatggaagcaaaagtttgagtcagcactatgaattggctttgcaatatgatattattccccagatatttagtttaaggccagtgctgatttatgatcgcatggatgtgtccttgtggaaagatttttcttttgatcgttttttcttttgctgttctcttttttatatgcataatggttggagctttgatgtaaactatatggcaccatcaaagtatatgaaaatcacttccggtcttatgactcattttcctggaatgctgggattcggagctggttacagtatcagcaactggaatattgatttatatatgcaaacgccgtacaaggcagtttctaaggggcaccttcagcaaattggttatgaaagaagatatgaaaaccgaatacctcgtgttagcgatcatgtaattagcttatcagtaaattatcgtttcacttttggaaagaaaaaacataaattcgataactcggttatacaagatacgaatcagtcaaccatatcaagcgattaaaacgaagcaaatgaatttacaagagatagaaatccggccattttcaacttcttcccttcatgaaacttttcttatggaggtttcgggacgtttctttgaaataggtaaagatgtggctgaacttctgacctactttaaatgtaacggttgtgaagaagcaagtattgaagaatattctaaacaaaatggaaagttttcgaaagaggagattttgacgtttttaaatgattttgctaagaagttggaaaaagagagcgaacttcctaacaaaagaaagtcttttctgtataatagagaactcatatcagcgaatgtcatcaacaaatgttcctcgttgttagctcctttatttaataaatggttcatattgttcgtcatattattttttatagctttggatgttctctactttatagaatacagtacaataggtaaagaacacctaaatttgaatatttatattttaagcggattactattcttttttattctttcttctctttttcacgagttaggacatgcttcagcttgtcgctattttgatatttctcatggagggatcgggcttggattgtacattaatataccagtcttttatacagatgtatcaagcgtctggaaacttccaagaaaaaaaagatgtattgttaatgttggaggagtctatttccagatattacttttaattccatttttggtaatttatttatattctcaaagtagtttattgagctatatcatattgattatgaatttcaatttcctactcacactaaatccattctttaaattcgatggatattggattatgacagatgttttaggtgttgccaatttacgtcaaaaaggaaaagaatggatgctgtatatgataaacaaatttaggcataaaaatactaataaagttccttacttaatgtcactctccaaaggaactaaaatagcattggttatctatacaatagtggtaaacttctttttcggattttatttcttgtatatactaccacttttttttattagattctatcatacttttcctgaaagaattgaactattattaatgaatctgtcacatcatcaaatgcctaattgggggaatctgcaacaatgtattttacaaatagtgtttttgtatttctttctttatatgctgtatagaatgttgagtccgttattaagaaaaataatatggaaaaaataataaataaaatagcttgttgtttattggttttcatgtttcttatgcgttttttctacgtacaagatccatactttatctgtacttttcttttggttatttgccttactgtctgtctaaccaggcaaatgataaaactgactatcattgatttatgtttgctccttttatgggcatatatagggatgggacctactgttaatttcgcagggagtgcgtattcttttattacactcacatcaaatatcctgtattactttcttttgaggtatattatcacatacgataagaaaggagaacagtcattgctatcatcatttaccgtttgtattgctgtcttatccgcattagccttttattctttttatcttttctgtgtgtcagtgcatgaaatgggttttagttctctttatgatttcagatttttatataaaccattgggagtacccaataatgaatggagtagccttcaatggttgtttggcgggattataacggctgtctatatttatagtgagaataaaataataaaaggtatagctttactatcaggtgcaataatcttatgtttggctttagtttcattctcacgaggtatttatcttgccggtattgttttcatcatattgttaattgtgctggaacataggaaattattcgaaaggaaaaagataattattggtggaggctattgtttgttagtaatagttgttgcttgcctttattcaacagaaataaaaaaaacacttcatggaaatgagactgtatcccaacagcgtagtacgaaaagccgaataaataccttccaattaacaacggatgtcttgaaagaatatccttttggagtgggactcaataattacacattggcaaaggactattatttgcatggagaaaaaagggttgactcttatacttcatacgctgcgaattcatttttaaagataggtattgaaggcggatatgccggtctgatattttatatattatttcttttatccatagtttactacttagtgaaggcgaagaagcgtaatttgtggctattatttctttttctgttcgccttttttcttcgggaacaaacattttctacattctttgattccagtagtgtccgattatcagctttgatattaatcgctttcctgcaaaaagaagaaatagtaattgtgcaacgatcgaatataaagattttagctgctataccctgtttggcatggatatgtgtattttatatttttagatttaattgtaacgttaatcatgatgttgcaagattagttaatcagtctatggcttatcgaaaggttaatataccaaaggcgttgacatgtataaagcaagcccaattaaaaaatcccttagatgttcatctggcttattatgaatattgctggtcagaaaaagaaaatgcagttcacaacgaagataaacttagaaaaatgacggaactctatcctgacaaattattgttccggtggacactatatgagcaatataaacaacagcatcagttagagaacgctgcaactgaattaagatcttgtatcttacaaaatcctcgaattcttgggacttctttttggaaagaacttaatgaacaagagcctggattcgcagagctggtagtaggcggattattaaaagaaaaacaggaaaagcctttaaatgtaatagaattagctaagtggggaagtattgctttacaattaggaaaaaacgatttagcactgtcctatttgaatgaagttagcaaacaattacccaacctatcccgggtatggtttaatttagcttccatattggagaaagagggaaaattagaacaagctagtctgtaccgacaaagagggagtataatggaattaggtgttttttctaaagacagaagttatatgcctcccgtagagcaagatataaataaaataatcaatgagcaatactcttttttatttaatctgtggtataatgaaaatttgaagaatgaaatagaataaagatatgaaagcgttgatgaaaataagttttttgcttctcggtgttactgttatttgctggggagtatatttctactctggaaataggattatcacacggaaagttttagcacattatcaaaatgattcattgaaattagcggcagcaacattcttgttggataatataggtgacaaatttgcttattgtaaagaggatattgaacgttatgacacgatttttgcactttatgatgaattaaataaaaaaggagaaacctcatcagaaccagaactggcaaaaaaatgttggcataccttaattcagacttatgggaaaatgaaaccttcactatttgaacgtgaatatgataggaaaactttatctgcatcttttttaatagataatattgatgtggcttttgaagcatggcaaacagcccctaattttatcacgcgtgattttaatctattctgcagatacgtattgccttatcgggttggcaatgagccaatagagccggagcgaagaaaacaattcgaggaattgcgttctctaagagattctatgtttgacgaaagtcggattataaaagatctatatcacgaatttgtcaaagtacgtaaataccaaaatagtaagcaaatgtggaattatgcgatatctttaactaaatctcaattagaaaaaactcgtagaggatcatgtcgtcatttttgtgagtattatgtggcagctttacgtgcttgtggcattcctgcaacaatagattatgttaattgttgggggaacagagctggtggacatgaatgggtggcagttctaaaggatagtggagcatttcttgcttttgacgcattagatcgaaagaaaatgaaattggcttataaaccagcaaaaatttatcggcaaacttttgaaacacaggttattgatgggaatgcgagaaaatatgttcctgactatatgctaaatccaaatcgcatggatgtctcacatctttattttaatacctatgatgtggagataaagggcagtgatatgaaacaatataagaactatccttatggagttatttgtgtgtttgataataagaaatgggtacctgttgattttggtaaggtgactgatggggtatttcattttcaaaatatgataggcgatgtatgttatatggctggtttttatgttaatggaacttttatttcggctacagagccgtttgttctaaccaaaagtggtgaagtaaaattgattcaatgttacacaaaaaatcatgtagatatgcggttggttcgtaaatacccgaaattcacacgcatttcttcttttaggaaaggactattgggctctaaaatagaagtatcagatgatagagaattctcttcaggcaggaccttgataacaattgatgaattagggaatgaagatatttttgattcaaccgtaacagtgaatagaccatacaggtatgtgcgattcgtttttgatgaacagaaagaaggtaatttggctgaaatagaattttatgggaagaagagagggacaaatgttgaagttctattgacaggtggatttagcggagaaccaataaagcaaactaaaacaaattggacgatggctttggatcggagtttcgatacttattttaagaagaataagggagaaaaaggtaatatttgtttagatttaggaaaggataattcatatgagataacgcgcgtaagatatgttcctcaaacagattctaactttatagttccgggaaatcaatatcgtttggaatattgggacaattcttcttggaaattttttggagaacagattgctaccgatttcagtttaaatttttcaaatgtacctactggtcgattatatattttacataatctaaccaatggtgtagaggagagaatttttacttatgaagatggtaaacaagtgtggtggtaagctttatctgttattaaaaatgaatgttatttatgaaacgattattgactttattaaatcgttgcgtttaaaatgatctttctttaaaaaccgtatacaaagtgtgtatatttaccaatgtatacacatttgtatacggttaatgtttttatattaatctattaatggttttctttgttacaacgtgaatgataaacttttatttggactaatattatgataaaacatctattcttttttattttcgtatctatgctacatctatcttatggacaaaaaagatacacaatcagaggtgaatttcctgatcattctttggataatgaatatgtattgctatatgatttctcatctcttcaaggtgaatatgaacgttcaaagcaagcattcattgacagtatattggtggtcgataaagtgtttcattatgaaggaacgatcaatcaagaaccttttttagcattagttctttgtagtaaaagcagatatcttaaatatagcacaacttttatagtagaacctggcaatattcagatgcgcgttgttgactgggcaagtgatggtgatgtgtcaggtacttctataaacgacgattacaacaaatatattattgaacgggggaaacaattggtaagacgcgttctttaagaactaaacgagaagatacaataaaaagtgatactctaaaagataataaatgtatatctttaagtgaggtatacacatatgccgaggaagggaaatttattttcttagagaaatatgctatgtatccaaatgttgtacgatattggttatctttctatttgaatgggcgaagagcgtcaaagagtcctgttttctccaaatgcctgcatattctcaatttaatgcccaaagcggatcgggacatccttttggcttggcgggactatactattaaaaaggaggagtatagagaaaagactaaatctctgttggatagtatacataataatgcccctcgtttcattgaggctatttcaaaatagctcttcttaatatgaagtttgggtgtagttgctcttttgaaatttagttggaaagctcgtaatggtgcacaaaggtattaaatagtgattaacggattagtaattaatcggtgcggtttttaattattacagaatagaatggattttctcatcggatatttattttcaatctttctatgttttctttcaccttttctctgtctcttcgatgaataaggagtttgcgggtgaagggtaacaacttcaccacctcttcacctgtggcgattagtttcaaaaatagtttcaaggcttgaaactattcgtttctcggtgtgaaacacttcgtttcaaagcatgaaacactttgtttctcggcgtgaaacttttagtttcaaatagggttgaaactaattacgaaatagctttactaatcttgttcaatggttaaatcaggaagcagctatttgatttgattcacgatgaagagaaggtgaaagaccgactattcacctgcaaactccttatttatcgaagaaacagagaaaagtgaaggagatggaagaattgaccatgttatagagaaaagcattgaattgttcaaaaccgtaccgattatgaaccaatgcaaatcattggtcggtatatggaaaaaatgacataaatatggataataatccttgtttcgaaatagcctgctaagttttttgtattcattattccttttggctagttttgcttgtgtaaatcttaaaaagccatggaacacataactaaaataaaaacagttttcgctattttactattatatatcataatagttccaccattatatgcccaatctataagtgtccgttcattacctggctatgtaaaagcgataaatcaattcaaccaactgaaccctcaagaaaaggtgtatcttcattttgacaataccggatattatttgggtgatactatttggtttaaggcttatgtggtatttgccgagcaacttcgtcctacaactttaagcaaagtgttacatgtagagctgttgactccacaaggcatggtagtggatgaccgccaattgaagcttgaaaatggtgaatgtcatggtgaatttgccttgagttcccgttatcatagtggtttctatgaagttcgtgcttacactcgaagtatgttgaattttggtgacgattgtattttttctcgtgtatttcctgtttatgattctccggaaatagaagggcattatactgatcggaagatggatagtggttttggcttgaaagacgaacgtaaaaaaaacacaaaagctaagaaagtcaacctttccttttatcctgaaggaggaaatgctgtggttgggttacgttcgagaatcggtttcaaagctacaggagagaatggagaagatttgaatataacaggtgcggtatatgattcttccggtgaactggtttcatatttctccacttatcaccaaggtatgggattttttgaaatgattcctgataagactacatataaaattgtagccgattatgatggaaagaaatatgactttgctttttcaaacattatttcttcaggatatgtgatgcgtgtgacagatttggatgcagagacttatcaggtacatctgcaaaaatctccggacttgccggctgatactttagccgtttctgtatcatgtcgtggtacagtttattcagcagaagctttaattttgggtgataaaccttatatttatcaattggataaaggaaaacttcctgccggttgccttcaatttactctttataatcaggatggcaaaattttggcagaccgtttggcttttaatcgtgctccgttagaatattgccgtgttacggtggaggcggataaacctttctataaacctttagaaaaggtgagactatcacttgctgtgaaagatttgtccggtaatcctgtatcaggcagtttttcattgtctgtgcgtgatgccggcacagaaattcatactggttatcatgagaatatcctgacagacttgttgctctcttctgaaatacgaggttacatcgctcatccgatgcaatatttcgggacggacgaccgtagtaatcgtatgaagttggacttgttgatgatggtacaggggtggcgccgttacaattggcaggtgatggcgggggtatctccttttcatgtggcacattatgctgaagagggtttaccagtgagtggtgtagtgaaatctttactcaagaataaggtggaagcgaatgtggatgttgtattttggattgttaaggatagtgcttctttccatggtcattgcaaaactgacaaaaaagggcgtttccatttcctgttgccggatcatgcggcagtagacggtgaatggcagctggctctttctgtgacttcgaaaggcaaaccgaaacattgcaggattatgctcgaccgcctttttagtccggaagcccgcagttattctatttcggactttcaggtgaaggatacggttattgtttttgcagacacttcagatagtctggccaatagtaatgttttaggtatgatacagaatcttccccaagtggtgataaagaaaaaacagataaagaatgagatatttccggatctggtttgtgatgtggaaaaggatattagtaggctaatggatcaagggaaggattatccaggaacattgggggaatatatggaaagaaatatttctgccgtaaacatggtagatactgcgtatacgtatgctaatagtgctatttgttatattttagatggtggaggttctgttaatccgcgaaagggcatcggtgcttccgatcatccgatagagaatataaaaacaatagaagtgtatgatggaaatcttcgggcttggatagtgagaaacatagatagtaattatggctattatcctccgagtgatccgacatcagatttttatagtatgagacatttacatgatgctgtttttcaggctaaccaaaggctggtattattcatcgtccgtttatataacgatgtgttgcatgacaagtataagaagggaatgcgttatacttttttcaaagccttttctcctgtaagagaattctatcaggtaaatcatagtaatagtgttccgggagatatcgattttcgtcgaactttgtattggaatcctgatgtgaggactgataataatggaaaagtgaacgttagtttttataataatgctacttgtcgacaaatgacgatcaatgcagaggggataaatcgtgggaagtgtattattaaagaataaatttatatggagattttactttttcatagtgttacattctatgttgcagtgcaaaagatgtatctttgtaaccagcaatcaaaataaccccaaccactatatgaaatataaattattatgccttttcgttttgtttagtttttctatatcggatttgtatgctgatattgaacttagttccaaacaaatgagaaccagtgatgggctacctagtaattctgtacgatgcatgtttcaggacagtaaagggttcttatggttgggtactttagacggattgacccgttatgatggaaatacttttcttacttatcagttggaaagcgggaaacacgatcggatttctttagcagataacagaataaaacatgtggcagaggataagaatggttttttgtggataaagactgtgccggaattattcagctgttatgatctacagaaagcttgttttgtagattttaccggtaccggaagtgatggagagaactattcagaaatatttatgtccgctaatggagatgtgtggctttggcatagaaggaatggtgtacgtcaaattgtttgtgaggacgatcggactatgacctctgtgaagtttagaacgaaatttggaaacctgcccgatgaccggattaaatttataaatgaagattctagtggcaggatctggattggtaccatgcagggacttgcgtttgtttataaagggaaagttgaatttatcgataggaaattgaatttttcttcttctttccctcatggagaggatatgtattttctgacaaagagtggagatgtgtatcgctgtgtaaatggatcgaaaaaaatagactgtttaacgtcgctgtctgctattgccggtaatacatctgtcagtacacattcattgataaaagataaatgggttatatttacttctagcgaaggggtatatgaatttgattttcagaattttcaaataactccttgccgggaattgaaaataaataatggaaaagttattcatgacaattatggagattgttgggcttacaataacactggacgaatttattatataaactcgaagagcggagaaataaagaattttcaactgatccctgaagagaagatgaaatatatagattatgaacgctatcatgtggtgcgtgatgaccgggggattgtgtggatttcaacttatggaaacggacttttcacctacgatattcaggaggaccggttggaacactttgtttcggaaggaaagaatgcgggacctatagggtcagatttcttgttatgtttgatgaaagacaggacaggaggaatatgggtaagctccgaatattccggtttgtctcatatttccatttcaaataaaggtattacacatgtctatccagaatcaccggatgtttttgaccgttcgaatacaatccggttactaactaaaatgtcgaatggagatatatgggtaggaacgcgaagaggtggattgtataattatgattctcatctgaaaactaagatagataatcattatttgccctataatatttatgcgatttcagaagatagtcaggagaatatatggataggaacccggggagacggactaaaaataggagatacgtggtataaaacggatccgtctaatccttttgccttatctcattctaatatttattccattcttcgcgataagaaagatcgtatgtgggtgggaacatttggaggaggactggatctggcagaatcaacggaaaaaggacaatataagttccgtcgtttttttcaaggaaagaagtatggcttacggatagtcagagtaatggcagaagatgagaaagggatgatatggatgggcacaagtgaaggtatctgcattttccaccctgactcattgattgctaatgaagataactatcatttgttcagctacaccgatggcaatttttgcagcaatgagattcgttgcctgtttcgtgatagcaaagggcgcatgtgggtaggaacttcgggtgccgggctgaatctatgcgaactgtcagacgactgtcagtctttgaaatatacacattatggaatagcggaaggactggttaataatatggtgcaatctattttagaagatcattcgggacaattatggattgctacggaatatggaatttcaaggttcaatcccaacagccattctttcgagaattatttcttctcatcttatacattaggaaatgtgtatagcgagaacagtgcgtgtatgggtgcagacggtaaactgatttttggaacaaactacggattgacgattattgacccgaagaagattccaacagagagattgctttctcctattgttatcacaggattgtccgttaatggaattcaggtgaagcctaatatgccgggttctcctttgcaagaatctttagcctattcggataagattacattgaaatatttccagaattcttttatgcttgatttttctactctcgattattcggataatggtcaaatcaagtatatgtattggctggaaaactatgacaagggatggaatgttccgtcttctttaagttttgccacttataaatatctggagccggggagttacattttccatgtgaaatattgtgatggtgccggtatttggaatgatactgaaacaaccttgaagattgttatcgtgcctccgttttggaaaacgaattgggctatgctcggatatttcatcctgatattaatagctttgtactttacatatcgtatcatttttaatttcaataggttgcgcaaccgcatcaatgttgaaaaacaactgacagagtataaactggtatttttcacaaatatctctcatgaattccgtactccgcttacattgatccaaggagcattggagaaaatgtaccggatggatgatattccacaagccttattgcatccgttgaaagtcatggataaaagtacacaacgtatgttgaggctgattaatcagttgctggagttcagaaaaatgcagaacaacaagttggctctttctctgcaggaaactgatgtagttgctttcctgtacgaaatatatttaagtttcagtgacgtagcagaacagaagaatatggatttccgctttttgccgtctgtgccatcctataaaatgtttattgataaaggtaatttggataaggtggtgtataacttactttcaaatgcttttaagtatactccttcgggtgggacaattctgttttctgtgaatgtggatgaggtgaagaagtgtttatacattcaggtagcggataccggagtaggtattcctaaagaaaagcagggagaattgtttaaacgtttcatgcaaagtagtttctccggagatagcattggagtagggttgcatttgagccatgaattggtgcaggtgcataagggaacgattgaatataaagataatgaagggggaggttccgtatttacggtatgtattccgactgataaaactgtttattcggaaaaagacttcctggttcccggcaatctcctgttggaagaagcgaatatgcagactcaccatttgcaggagctttcagaggaatgtcaggaacatgaaaagacagtcaccacatcaagaaaacataaaatattagtcatcgaagacgataatgatattcgtgggttcctgcaggaggagcttagtgcttattttgaagtagaagtggctgcggatggaatatccggatttgaaaaggcatgcaactatgacgcagacttgattatctgcgatgtattgatgcctgggatgaccggtttcgaagtgacaaagaaactgaaaactgaatttgcgacaagtcatattcctattattctgctgactgccttgacttcaccggataagcacctggaaggacttgaagcgggagcggatgtttatgttgcaaagccatttagttttaagcttttgcttgcgcaggtgttccggctgatagagcaatgcgaaaagttacggaagaagttttccagtgaaccgggggtagtgcgtcctgctttatgtaacacggaccgggataaggagtttgcagatcagttggtggctgtggtggaaaagatttattctcaatacaacatttctattgatgaatttgcgcagatgatggggatgggacgaactgtgttttataagaaattacgcggagtgacaggatactcaccgaatgagtatttgcgtgtcgtacgaatgaagaaggctgccgaactgtttttgaccgaaagggatctgactgttgcggaagtttcttataaagtgggtattaacgatcctctttatttcagtaaatgttttaaagcgcagtttggagtatctccttcggcttaccagaaaggggagagaagtaaaacgtagtatatacttaccttgaatccggtttgtgaaggatagaccggattcaagataagtatgtttatcagttacatattgaggtctaatttatagatttcacttccggcaagaaggaaacatcctgttccgaaatcctcaaaatcaggaactttgtcgtatgtgacaggttgactgtctttcggttctttgccggttccctgtacataaccaagaaaaccattcgggtgaactgcatccttcaccatagcattccatgcttttatgattacaggcagataggtctttttatccaatagaccgttgcgtacgccccaagccataccatatacgaaaagagctgtgccggaagtctctttgcctccgaagtttgacggatcgtggaggctgacattccaaaagccatcttcacgctggcattgtttcagtgctttgctcatagccataaaatcattgatgtaatcttggcgatgtttttcatcagatggaatttcgttcattacccgcaccaaagctgcgtatacccatccgttaccacggctccaataacagttttcgccattaggctctttgtatggaggatcgaaattatggtctctccaccacaaaccttctttgacattgaacattccgttctctccgtgtttattacgggtatattcgtacatatcccacattttgtcgaagtacttctgttcgcctgtaagtttccccattttggcaaatataggcatccccatctggatagcatctatccaccaccagtcgtttatttgtggagtattgaccagcatatccatattggctttcgttttccgtattttttcaggatcggggcaaatgttgtataaatcgagatagatttggctggcgcagtaattatctgcattacgggtggttgtcccacggtggaagccccattggtggtaatccgcccattctttggcatagagataatattcgtctgcgggatagatggagtagagtgccattaagccttcgtaatatacgcttcgtgtccagatattactggggcgaactacttttttcacaaaggaaggagtgcgatagtcggcatatttcttcatgaaatagtcgttcacatgaagagttactttcagaatttcttttttatcgggaactgtctgtgcttttatgttcccgtaactcaatattactcctgcaaaaaatagtataagatgctttttcattttataataaattagattactattgttcttagatttaggcacgcaaaggtgagcctttctttacctgttgcaaagaaaatgcattgtaaggaaagtgatattgaaatttgtacggaaaatatgtaatattagactttattctttattcatattagtcatggataagaaccaagtatgaataattagcaagagcgatttttttgtaagtcatattgttgtattgatatttattgtatatttgtagaagagtaaggggagacgaatatgaaaagtcatacaaataaaatattagagtctattaagcaggcattgacagagcatttaccaaaaggtggcaaggctttgttgtttggttctcaagctcgtggggatgcacggattgattctgattgggatattttgattatcttagataaagaaaaattggagcctgaagattatgataaggtaagctttcccttaactatgttgggatgggacttgggagcgcgaattaatccgattatgtatacgatgaaagaatgggctgcaagttgtattacaccattttataaaaatgtagagcaggaaggaattgaattagtatgaaattgacagatgaagaacgtaattctttggtgatattacagttggagaaagctaaagtatttttgaaacaagcagatgagatgtttgatctgaagtattgggatattgcttccaatagatattattatgcctgttttcatgctgttcaggctttattaatacaaaatggattatcatgtaaaacccatgatgggttgatagcttgctttggcttgaattttataaaaacaggcaaaattagtgcacgtttgggaagttttttggcgcgtatggaacaattacggcaaaaaggggattataattgcatttattcaatatcggaggatgaaatcagtacgataaaagctccggcaagagaacttattgagactattgaagttttacttgccgaatcataattattcttgtaaggatatcatcgttaaaagaccattttttttattttttcggccacatctgtcatatatgccggattaaattcttctagttccgtgcgtggtcggaatccccatgtcactccgcaagcggttacaccggcattggctgctgtttgcatgtctacaccggaatcacctacataaagaacatcttcttttcgtacatcggcaagttttaatatatcaaaaacgattgttggatcaggtttgacatttactccttcccgttggccgaaaacggcagtgaaatgaatttccggaaagtagtgggcaaccagtttctcggtagcggcctgatatttgttggaggctacggcaatctgaatgcctgcggattgcagataagacaataacgctgaaatacccgggtaaggacgactatcgtctgcattgtgaatatcataataaggaataaactcttttcttacccggagcacattctcttctgtcttttctccttcgggtaatgcacgttcaaagagtttgttgataccatttcctaccatgaagttatacttttctacatcgtgtgtggggtatcctaatttattcaaagcataattagtgctatgggcgaggtctgcgatagtatttaataatgtaccgtccaaatcgaatattattagttttttcattaaggcttatgtttatagttaattctatatttaaatcttttattctgcaaaggtatactaaaaaaatgagattgggaagaatgaggcaatagtttagagaatatcgaatgaacaacaaagccggaaatatatttgttattctaccagattggcttaactttgcgaaaaactaaagaataatgaatgcagaatggtttgaggcattgcctgaacaatgtcccccaacagatgcgaagcggtgcgaaggctgttattatagaattgcaaatggtaatcctgttacaacagaagatttcttttcgcaaagaaaaatgcagccggataaggtctttaaaggattaggaatagatgaatgtgtgacaagggcagtctctctattttcagagagggaagaagcggagaaaagattaaagcttcctaagttcaagaaggcaaatattgctttagtcatattggaaccaaaagatggagtgttaaagaaaacatttgatatagcacattattcttggtggagaacaaaggattttaatgttttacaagctaaaatagtctgattatgggaatggaagatgtgttaaggatagacaaaattctggatttctgtgatgtgcctcagctttttgtggcaagagatgcctttgatacactgtatctttgtcttttatatgatgatgagacggtttatcgctatacgggaatacgtatctctacacgtagacttgaatccttcttagcaggtaaagccgatttgcgtttactctatctacagcctgaaaatgaacatgagtattacgatgttgtgtttcaatcgggtgaataccagaaaacgttattaaaggaaagtgtattgttggaagataaattgccggctgagggatatgttttatctggagagaagcgcgagaatgtggtcattaatttgccaataaaagaccgtagtctgcttgcagagcttgttcgtaaatttggctgggcttgtatgtaagtttaaagaagataaaaaagattgtcccgctactgcttgaaagttgtgggacaatcttttttcatccttatatatactttgattacttcttcgtaatacggaaccagtcaacgtctgcccaaccgccgtcattcgttttaatagccggacgcgtacagaacataccgactttggcaccaatccattgtccttctcttgcctggaaaggaacacctaatgattcatatttctttccgtcgaggctatagctgaaattacacatcacaatgaggtcatgtccgccttcactacccttgattttctttccgtcacaactgaaacgcactttcagataaaccgtgttttgcgaaagatcaacagcggctttcacttcttctggtttgcctttatctgctctgtcacattcaacttgcgacagaaccaaacctttgtctgtattttctagaacaagtccggcataatccctgcccataacgacaagtccagtgcgttcgcctttattcttttggttagggctgaacgtcagtttcattgttgcggtaaaattatcagaaggagttttttgtaataagaggttggctacatcccacaggttcttataatcttctactaccggataagagtataatctgacatagcttttgtcacctgcataatacgcccatttttcattaatgttagcatgccattgccactgcggagaaagtgtatacccatcaaattcgtcactttcttgtggagtgcagataggatatgttttaccgacatttggcttcttgtaagtcaaaacaggttctccgcagccgtcaccgtctttatcaataccgataataggccagtcgttcacccatttcatcggttggagatgcataatgcgtccgtaagcaccgacatcttgaaagtggaggaaccagtcttctccggtaggagtatctacccatgcaccttggtgaggaccgttgacaggagagttaccttgcgcaagtactgttttccattcgtaaggaccgtagatgtttttagaacgtaatacgacctgccagcctgtcggcacaccgccggccggatggaagatataataatagtcgtttctcttgtacattttaggaccttcgcaagtctgatgtgcttcgtgaccgtcgaaaattatacgggaaggagtgatcgcttttgttgcttctgcattcagttcgcagatagtgattacacttttcagtccggcacgacttcctgcgtatgcgtgtaccatatatacttttccgtcttcatcccagaacgggcaagtgtcaatgataccttttcccgctttcaccaagaccggttcgctccacggacctttcggatctttggctttcaccataaaagctccctgatcgggatctccccaaaagatgtaaaactcaccgttgtaatgacgaatagccggagcccatacacgattgccgtgttccggccgttccggagtttcgataggggagagggcattgggaactgcggcaccgatgattgtccagttgactaaatctttagaatgaaggatttgcaatcccggcaaacagttgaaactggatgaagtcatatagaaatcatctcctacacggcaagcatccggatcggaatagtcggcataaagcaccggatttttgtatttaccgtttccgaggtcggaaacccatacttcagatacatagttcttctgtgctactgcggtgaaaaccgttaataagcaaaaggctaaagtctgtgtcaatcgtttcatgttatagatagattatttatagatatgattcgttggttttatctgatggcaaaggtaaataaaaagactctgcacaaggaggaatatttgtgcagagtcatagaaaaattggtagatacctcgtaatttttgtttagttgtatttgtttctaccctatttattggggcggttatcttttattctcactgtcaccggatgagccagctcttctttccattcgcggagatgagcaaaccatgcttccggcgttttatatccgaatgtctctttcatcgaggtgaaagtcgtgtgatactggaaatatttatttcccggggcggtaattgtataaaggaagttggctttatccttttcttccgattttacataacgttggggaatacaagtgcccagccctacagtttctttagcatattttacggtatcgtttaccggccagtccgttccccaacttcctacgagtcctttatgatcggagaaagatttggaagtacctacgatgtcttgcacacctgtgcagaaaatttctttatcgagcggttcgtcaaagaatgcttcgatatgaagatcgcgatgtccggcataaagcgtgtagcgtgtcatcatattcagttcctggtcctgatatttccatccggttacttctatttctgcaattacacgtaccggtccataagagacgatacgttctgtacgagtgtccactggagtaatatgggttgccttttgtccgtcccaacctttcaatgcacccggtccgcaactgtcgaacacgcgaagtacgtcatctccgaatcctttagctaactgctcatccgtcggatagaactgcgattctttgatttccagtcctttgttgaacttgccgtaaatatccggtgtctgtttttcattgaaataaagacggtatcctaccagttccgattccaaaaccggaccgtgaggacgtaccatgctgtatatattgctagtgccgggaacggtgatagcctgtacccgttgatgtttacctttcttgttgtctacaataaacatatcggcataaactcgttcaggataagtctttgtactcttttccgaagaaagtgtaacctgaaatgtttttctaccatgggcaggaagatcggcaacaaagaccagttcgtccatcttgcggtcccggttcaaatcgtccaactgcgaaggaatttccttccttccttccatgacaacggctgattttactttgaaaccagcgtgcaactcatgtagattgataacaaccggagcatccgctttgggctgattccagttgttttgtacttcaactgtgatggttttctcctgtttctgcgtttgggcagacaggctgaaagctcctaaaaagaaagtaataataaaaagattcttcttcatgtttctaaggctgaaattatacgtcgtatttctccttgcaaaaatagcagaaaaaatagcagactgtgtctcttttgaggagattatagtctgctatttgagctttttactctatataatgatattgtggtttctattttgcatcacagaatggcaatgagttttttatttgagacttaaaatctcctcttttgcacctaattcctcatatacctttccgtctatagtcagattcttggcattcttaacgtttaatatattgttacctttagaagattctacataaatattttccaaagtaactccgtctacctgactgataacaactccatccgcagcttccgtcatcacaacgtttttaacggtaatattgctgatgggcatttccggcagtccgttgaagaacatggcacgtcccgaacctctgcaaacaatattggaaatatgaatattgcggaaagctggtgtttcttctgtcaccggaggaatggcagttttcatacggctcaacagatcttcttccgattcttcaccggcaccttttccaccgtagaacaagtcgaacaataagggttcattcggaatattaatcatattgatattgttaatgtagatgttttctaccacaccgccacgtccgcgggtactcttgaaacgtaaacctacatctgtacccataaatgtgcagtcctctacatagatattcttcacaccgccggacatttcactacctaccacgaatccgccatgtccgtgcaatactgtattgtttttcacgataacgttctggcaaggttctccacgacggcgtccatcttcgtctttaccggatttgatacagatggcatcatctcccgcatcaaacacactattgataattagagcgtttttacaagattccaagtcgatagcatcaccgttttgagaataccaggggttgatgaccatgatattatttactgtgaaatcttcgcaagacaatgggtgcagacaccagcttggtgagtttttgaaagtaactccttccaacagcaccttcttgcttttgacgatgcttaacaacaccggacgtaaccatggacggatttcagcccattcttcatctgtgttgataccttcggggacattgaagtctttgcaagccattgcacctctcagtgagccggcagtgggataccatatctcttgtttctcgtcgagaacacctcccgagtttaccagctttttccattgtgaagcagtcagctttcctttttttaccggacgccagcagtcaccgtttccgtcaaatgtaccatgtccggtgatagctatattttctgcattgcgtactgaaatcggtgattggcaacgacgagtctcgagtccttcgaaagaagtggcaatgataggatatgcttcaaaatcaccggtaaaaagtaccagcgcattttgttccgtatatagatttacattgctcaacagctcgatcggaccagtcaaccagacaccttccgggataatcactttaccccctccgcgttgattcacgtctttaatagcatcgttgatagctttggtattcaggaacagaccgtctcctttggctccgaatttctcaatgtttacttcgtaagcagggaaaaccggttgctgtactttcggcatttcaaaaggtaaattctggtaaagagcgtcactgatggagctttcttttacggtagtctcgctttgtttacatcctgatgagataaacggtaaacagcatagggccatccagaagagtctttttgtcaatgtgttcatttagtaacttatttctatagggttatacatctattgtttttcttggtaattgggtgatgattaatgagggcgatttcataattcttatgtccttccgcaggcgatctgtcgcaggcagcctgcaggagaggaataagacaaattcatgttaacctaattctaaccttaaataaatattatgaaaaaacctcttaattatcgattgcaaagataggtggcaaaccccaagaggatgtggactaattgatagaatacgtgtattttttgtcatttctgtctattatttgcacacttctcgtgtttttatgcagaaagttcctatctttgcacaaaatttaactattaaaagatatgagttataacttgttgaaaggaaaaagaggtattatcttcggtgctttgaacgatcagtctattgcctggaaagtagcagagcgtgccgtagaagaaggtgcaactattacattatcaaatactccgatggctatccgtatgggagaagtcgacgctttggcccagaaattaaattgccaggttattccggcagatgccaccagtgtagaagatttgcaaaatgtattcaagacctccatggatatactgggtggacaaattgattttgtactccactctatcggtatgtctcccaacgtgcgcaaaaaacgtacttacgatgaccttgactatggaatgttggataagacattggatatttcagctgtttcattccataaaatgattcagtcggccaagaaattgaacgctattgctgattacggttctatcgttgctttgagctacgtggccgcgcagcgtactttctacggctacaatgatatggcagatgcaaaggcattgctggaatctattgcacgtagctttggttacatctacggacgcgaacatagcgtacgtgtgaatactatctcgcagtctcctacatttactactgccggttcgggcgtgaagggtatggataaactgtttgatttctccaaccgtatgtctcctctcggaaatgctacggctgacgaatgtgccgattattgcatcgtgatgttctccgatcttacccgtaaggtaactatgcagaacttattccatgacggtggattctccagtgtaggtatgagtcttcgtgccatggctacttacgagaaaggactcgatgagtatatggacgaaaatggtaacatcatttacggataaaaaaatatgaaactacggatctctcttcttattattttaatgagtatgcttttcgcctcctgcgggataagcacgggaaagggtacggagcagaaggaagaggagatttctgttctaagatatgataagctgttgagcgaatacgttcgctccaacagcttttctgctatgcagaagttgacgatggactaccgtatgccgacgaaaatcctgattgaggatgtattgtctatcggtacggtgaaagatgataccatttcgcaacgtctgcagaaattctattcggatacgactttagtccgtttgcttagcgacgtagaagcaaagtaccctaatctggatgaggtggaaaaaggacttaacaaaggattctggaaactgaagaaggaagtgcctgatacaaaagtgccgtttatctattcgcaagtgtctgccttcaacgaatctattattttggtggattctttattagggatcagtcttgataaatatatgggggaagattatcctctttataagcgtttctattacgattatcaatgtcgctcgatgcgtccggaacggattgtgccggattgttttgctttttatcttttgagccgttacggaatgaactatcatgagggtacttgtttgattgacttgatgatgcactccggaaaaatcaactacgtcgtgcaaaacttattaggatatagtgatatcggcgaagcgatgggatattccaaggaggaaaacgactggtgtaaggagaatgaaaaggagatatggaattatatctgtaccaacgatcatctgcatgcacgagacccgatggtgatccgctattatatgaagcctgctcctgctgtcgatatgttaggtgctcaagctccggcattgattgggacatggatgggagcaagaatcatcgcttcttatatgaaaaagcataaggacatgaaactgaaagatctcctggaatttactgattatcatgtgatgttaagtgaatccaactatctggcttcctaaactgttgcatttttcaatttttaattagcttcgctcaaaaccttatttgatttttaatattaaagtatagtcttaattttcaatttaaaaagtggaaactgccctctatttgttgcccgtgacgttaggtgatacgtctattgaaaaggtattgccttcttataataaggagatcatttctggtatccggtattttatagttgaagatgttcgttctgcccggcgtttcctgaaaaaagtagaccgggagattgatattgatgcattgacattttacccgttgaacaagcatacttctcctgatgatatttccggttatctgcaacctttggtgggtggagcttcaatgggggttatctccgaagcaggttgtccggcagtagctgacccgggagcggatgtggttgctatcgcacagcgtaaaaagctgaaagtggttcctttggtcggaccttcttccattatcctttccgtgatggcttccggctttaacggacagagttttgcgtttcacggttatttgccgattgaaccgggagaacgtgccaagaaactaaaagcactggagcagcgtgtgtatgttgaaaatcagacgcaacttttcattgagacgccttaccggaatcataagatggtagaggatattttgttgaattgccgtcctcaaacaaagctctgtatcgctgccaatattacttgtgaaggagaatatatacagacgcgtacagtgaaggactggaaaggacacgtgcccgatttatctaagattccctgtatttttctcttatataaataacgcctttcaggtgttcatattcatcttcgaagcagctgctgaagaagccttttcctaagttttcctctatctgtttgaaattccacagcttactgtttttaaagcgaggggtacaaaggatggaatcatctttgatatcgacaatgaatagatagataagacggttggtcacttcattctcgaagtgataaacgatgttgaattcaggtttgatacctttttcatgaggaaaagcattgttgattaaacgagtggcgcctgcttccagagattctccgtagcggagataacattccatgggaatatctacttttcctctatccagaatggctgttgatggcctgtcgcaaaggaataacattccgtgagtggatatggcaattcttatcaccggattgatgtatgcatttttgtaattaacagcttctattgcaggtgttttcccgatcacgtctccttcggtattcacaataggaacatattccgtgtgtgacattaaatgattgaagaaacggatggcgatctgattgaacaggatactcatcagaaagacagcaggggggaacactttatagagtacaaacatgctcgtcttgctcaacgggtcttggaaaacgatggtaatgctgattataataaaatgcaatataccgaagatcaaagcgatacgggcagatacaacggctgcttctgctccctgcgcatataaacgtttgttgcaagaacctatctgttttaagaaatggttgataaaccttttcttatgcatgtaaagacttagcatcggaatgagaatactgacttccagcgtaagtggaagtgcaccgggtggaacgtaatcaccaggaatgagagctgctacggataatagtgctaacactccggttgctatatagaggataaaattaggaattaacaatcctttacgtcgataagaaaggtatatacctataatacctatgcctgtaccgatgtaaatagccgtgtcttgcgttataagttcacacaataaaatggaaataataacggggataaaacccagcgacatgttaaatgcggaagaaagtgttcctttatgagccatctctatatttatgtttatttgtcggttctatcaataaaacaaataggggatatgttttgtttgctaacgaatatgtttctctgcatggtaggaggaacgaacaaggggagcgctttctacgatgttgaatcctttctctaaacctacagttttatattctgcaaattgctgcggagtgatgtatgctgcaacgggataatgccggtgactcggttgaaggtattggcctatggtaagaatctggcaaccggttgctaacagatcatccatcaatgtttcgacttcctccggggtctcacccagtccgaccataatgccgcttttagacttaactcccttctcggaaatgtgtctgataacttgcagacttgtatcataatttgccgcactgcgcactagcggactaatgcggcgtacggtttccatattgtgtgaaataatgtcgggacgggcttcgattaccaaatctaacaactccatcctgccttgaaaatcaggaatgagcacttcgattgttgtttgtggattcagccgttttatttcctggatggtacgtgcccaatgtgttgctcccaaatccggcagatcatctctgtctacggaagtgatgacagcatgatccagtttcatcagtgcgatggattctgcgacatgggtaggttcgtttgcatctagcgggtgcgggcggccggtttgtgtgttgcagaatttgcaactgcgcgtgcagatgtcaccgccaatcataaaggtagcagttccttttccccagcattctcccatattagggcaacgcccactgctgcatatagtatgcaagcagtgggagtcgacaatccgtttggtttcggtgtatcgttcgttggcaccaatattaattttcagccattcgggcttacgtactctgtccgtcattataaattgttcaagaaaaagttggtcaaccgtgtgtataggtgttggcgggtattgccaccatatattccatgattgcggtttgtatacacttgcatatcaaattgttttccaagctgaaccaactgctcggcatattccgcacaattttggaagtgcacattatcgtctgccatgccatgcaccaacaacaagtttccatgtagtttgtcagcgcgggtgaaggctgatgattccttatatccttccgcgttctctttcggagtacgcatgaagcgttcggtataaatcgtatcatagaaacgccagtcggtgggtgcagctactgctactcctgctttgaatacgggagttccttcgctcatgctcataagagtcatgtatccgccgtagctccagccccagattccgatgcgatctttatccacgtatggctgtttgccgagatacaaggcagtctctacctgatctttggcttctttgactccgattttcagataagtgcatttctcgaaagcttctccacgacctcctgtgccgcgaccgtccacgcataccacgatataaccgaggcttgccatgtatgtttcccaactgattccccaggtatccaatacttgttgagagcccggaccgctatattgatacatcagtaccggatattttttagatgcggaaaaattaaccggtttcatcatccagccgttcagcttcacgccatctgtggtttggaaagtgaagaactctttttgtggcacagcatatccggacaatgtttgtttcaatccatcattggtaataagcgttttgagtgttttgcccgaattatcattcagtgtaaccagcatcggagtattcaagttggagaacttgttcatgtaatacttcatcgatttgctgaagagcggtgtattggttcctacctgttgggatagtttgagcttcttgcctttcttgtctattttatagacagctttgcgcagagggctttcttcattgctggtgtaatagaaagaaccgtcttcttcatcatatcccagaaaatctttcacctcaaacttaccgttagtaacctttttaatcagattaccccccatgctataccaatagaggtgactgtaaccgtcacgttcgctaagcaggctgaaatattccggatagaactggatattatcgaaaatattctcctttatgtaataaggagactcatcgcgaagcattagtttgcaaagtgtggaacgaggatcggcaaagtaaagatcaaaacggtcttgatggcggttcaatgtcatgatagccaatttattggcatcctttgtgaaacggatacgcgggatgtatccatctgcatccaacgggagtttcattgtacgggtgacatgtgatttgatgtcatacgtacgtacctctactttcgaattcggatatccggcttttggatacttatatgtatattcgcccggataatcttttaaagcatcaatgcggggtgcttgtccggcaaataccgggaaagagtaggagggaacttccgactcgtcgaaacggataaaagcaatcagcgtattgtcggcgctgaattccaaagcacggtcgaagccgaactcttcttcatacacccagtcaggaataccgttgattaccgaattctgtttgccatcttctgtgacctggctttcgctgttgccgtaaagcaacttaacaagaaatatgttattgttgcgtacaaatgcaatcatggtaccgtccggagaaaagacggggacctgttgaggtccaccgtcagacagccgttcaataatgttgtttgtcgtaacgcccttatcatttcgtttcaaagggtaaatgtaatgtacagctgtgtatgaatgcctataaataggtgttgttttagtagcaatcagcagtttctgaccgtcgggagagaactgataactgtcgaagttcttgaagtcacattcgcgtgtggtatttacatcgaaaatcacttctactttctcgcctgtcttgaaagagtatttaatgatttgcgtgccgtcagcgttcatctgtgtgtagtgttcaccatcaggcatagggattactccctgaatattttccgggcggaaacgtccggaagtaatatcttttaaatcgagtgccttttgtccttgtgccattccggtcagacagagaaggcagagtaataaagtgatgctgatctttttcatctgcgtttataatcggttttggttttaattcgtacttgcaaaagtaacaataaacttagattcaacaaagcctgaccgatttttatatagatttgataaggattattgggtgagattcaatatctttgtgaaaaggactttaaacattaccactatgaattcaaaaagaaaagacttgcaatatgcttctgtcttcttattggccgtggcattgacgttcctgatgggaaagggtgataatctgtggttggtgtcatggggtgacttgataccgagtttgtttgtattgttcatagcaggtgattgtttacatagttccctgcttcgtatcaaacgtggcgaagaggagggaggagcccggtggagtacttgtttcacttttctggtattcagcattatttttatgggcgacttgttctttatcggcaactttattgtcaataaactgtggagctaaaagagatgtaataaatctgtttcacaggtgtttaatagtagattcttcgtcttaactatagcttttagtttactttaactagataaattagtttatgaactaaaacttttcgttatttgcagcaaacaaagttgcagatatgaaaggattaacagcaaaagaagaagaaatcatgggctttttctgggaaaaaggtcccttgttcgtgaaggaaatgttggctttctatgaagatcccaagccacatttcaatacactatctacgattgtgcgtgggttggaagaaaaaggttttctagctcattatactttcggaaatacctatcaatattatcccgtagtcagtgaagaagattttcgtaaaggaacgctgcggaatgtgattagtaagtattttaataattcttacctaaatgccgtttcttctttggttaaggaggaagatatttccttggatgaattgaaacagctcatcgaggaagtggaacaggctgacaaaaaacactaatctattaaacgaaaatctatgctatgggagttttcttcatttatatattaaaatcatctgtttgtcttgttctgttttacctgtttttccggttattacttagcaaggaaacctttcatcgtttcaatcgtatggctttattgggagtgttgttcttttcattactcattccttgtatcgaagtaactacccggcatcaggttgaagtgcagcaggctgtgctttccattgaacaattgctattgatggcagagttggaggctactcctgccaatgtcggtgcagtgcaggagacgtcggccatatcttgggtacagattgttctgttggtctatctggcgggtattctgtttcttgcctgtcgcaatatctattctttgatttgtctcttccggttgatacattccggcaaacatgagaagttggagaaaggggttacacttgtggtgcacaatcaggagatagctccgttcagttggatgaagtatattgtcatcagccggaaagacttggaggaaaacgggagggaaatccttattcatgaaatggctcatattcaccatcgtcattcagtagatttattggtggcggatatttgcatcttttttcaatggttcaatcctggtgcatggttgttgaaacaggagttgcagaacgttcacgaatatgaagcggacgagaccgtcattaatgagggggtaaacgcgaaagaatatcaactattattaataaaaaaagccgttggcacaaggctctactctatggccaacagctttaatcacagtaaacttaaaaaacgtatcactatgatgttaaaagaaaaatcgaatccgtgggcacggttgaagtacttgtatgtacttccgttggcagctattgcagtaactgcttttgcccgtcctgaaatctctgaaaaagtggaagagatttctgcagtcaaagttaatgatttggcggaaattgtggaaaaaaagagtgaagaaaatgttgttaaggagcctattgatactaccaagaataaggtagtagtggtaggttatcgtacagaaaaaaaagattctgtcttaacatccgggaaaaagaaggtggctatttcggtacaaggaatttccggtgaaggaaaacctttggttattattaatgggaaagagtctgaacgtgaagtagtaaatgctttgaatcctgaacgtattgaaagtgtgtctgtcataggtcctgaaaaagctattaagatttatggagaaaaggctaaggatggagtgatggatataaaactatattcggaaaaaaagtttgcgccgagaaagattgaaatcgaaggcattaataaaacaaggttggatgcattaaatagtggggcaaagagttggggagctacgtttcgttctgctgatggaggtaaacctttggttataattgatggcaaagaggctacaggtgatgatcctttagcgaatatttctcctgatcgtattaggagtatatctgtattgaaagataagactgcattggctgcttatggtgataagggaaagaatggagtgattgaagtaaatctattagtgaaagaagaatatcaagcccgtcaaatttctattcgtgctattaatgatacagtgacttcaacaataaaagtaactgcatctgaagaatagcagtagattttagatgtcttctgtttctaaatattgtcaaaatataatgttataaagattgacggaggtacgctagtatctccgtttcttgttccgggtggaaccattttatttcttcatctcttttgaaccaggtcatctgtttacgcgaataaatgcgggagttttgcttgattttgtctatagcaaaggagagttcccattctccgtccagatatttgaacagttctttatagcctactgtattgagtgaattgaggtgacgatagggaagtacggaacgtacttcttccaataatccttcctccatcatctggtctacccgacggttgatacggtcataaagttcttcccgatcacgagtcaggccgactttcagaatacggaaaggacgctgttttttttgttgggtgcgaaaagaagtataagtgcgtccggtcatatagcaaatctccaacgcatgaatcacccgcttgggattctttaggtctacaatccggtaatattccggatctaacaagcgaagttctgcgcagagttgttcaaggccttcctcttcatacttttgtaacatgagttgacgggtttccgcatcaacggtaggaatatcgtcaattcccttacagatagcgtctacatacatcattgagccaccagtgagaatcacgacttcgtgttgcgtgaataatttctccagaatttccagtgcttctgtttcgtattgggcagcgctgtaatagtctgtgaggtggagcgtgccgaccagttgatgggggacacgtttaagttgatcgggagtcggagctgccgtacctatttttaattcggcataaagctgtctcgaatcggcagatacaatgcttgtctgaaatgtttctgccaagcgcaggctcaactctgttttccccacacctgtaggacctataagaacaatgagagtaggcatagatttttaagtattaagtatagaagtattaagtattaaagcgtacgggactaaaaaaatattaggtattaactgcctgacactacatagcaattaatacctaatacttgatatttaatacttaaaatttttcttcttcgtatgggctgctagtgtcaccacctatgtcaaatccttcctgatcgaaatcttccatgtcgaagtcctggtctccatagaagttttcatccagatcaagagaacctcccgcagcggtcatttcttcaaaatctaccgtttgtttaggagcatctcctgatttcttggtacatttggcaccattcatatcttttccggtaataatttcggatagttcgatgaagaaacaacgttctgttatgtaatcgaatacatatagcagtttctgtttttcgtcttctaccagttcactgatagcagtgtctttcattacccagctatctatttccggattgtcgtccatttcttctaaggttacttcttttcctttttcccagtcgtcatcgcagataaagaaagaagtcatctggtcgtttgcgtaccctactgatttcagtattgcttcatggaagtcataaaaagttgcttccggatcaatttgtatttctctgacaaaatcgtcaacttcatcagatatgatagtaaatctgtatatcataatatgactattttgaactgtttatttaataataccacgttctgaattacggataaaattgactatatagtcaatctccgggctcttttcgaattcatcttctatttttttcaatgcttctgtcgtgttcaaaccactttggtagatgatacgatatgcattgtgaatactttcgatcacttcattggagaagccacgacggcgcaagccgatgatattgattccgctgaaagcgatcggttcgcgtcctgcaatgatgtaaggaggaatatctttactgaaacggcatccgccctgaatcattacatgactgcctacatgacagaattgatgcatcaatacattggcgctgacaatcgcgttatcatcaatgacgatttcgcctgccatcttggtagagttaccgatgatacatccgttaccaaccaatgcgtcgtgtgctacgtgtacaccttccatcaataaattgttatttcccacaatcgtgcgccctttagctgccgtaccacggttgattgttacattttcacgaatcagattattatctccgatttcggctgtcgattcttcaccgcgaaacttgaggtcctgcggaatggctccgataacggcacccggaaaaatcgtgtttccgttaccaatacgtgaaccgtataaaatattggcgttagccataattttattgttgtcgccgataactacgttcttatctataaatacaaaaggcgcaatttctacattttctccgatcttagcttcgggatggatatacgctaaaggacttatcatgcttttaaatatcaattattacttattttttactatttgtgccatgaattctgcttcgcaaacaactttctcgccgacaaacgcatatcctttcatggtagaaatgccacggcggataggtgccagcagttctacacgaaagatgattgtatctcccggcactactttctgacggaatttcactccatctattttcatgaaataggtagaataacgttcaggatcatctacggaattcaagacgagcaagcctccgacttgtgccattgcttccacttgaagtactcccggcataacgggctcctgtggaaaatgtccctggaagaaaggttcgttggctgtgatatttttaatacctacaatgtagttggcaccaatttcaatcactttgtccaccagttggaaaggatagcggtgcggtaacaattcgcggatacggtttacatccattattggttcacggttacagtcgtaacttggtgcctgtatttcgtgcagacggatttctttccgcatctggcgggcaaatttattgttgatggtgtgtcccggacgggtagcgatgatacggcctttaatcggttttccaattagagcgaggtcaccgatgacatcaagcagtttgtgacgggcacattcattgggccaaactaacggtttgtgattgatatagcctaactgatcggcatccatgtgaggtactcccatcacatctgccaacttatcgaagctttcctgtgacatcttgcgttcgtagattacgatcgcattgtccaggtcgccacctttaatcaatccggcggagagcaacggctctatttcacgaacaaagacgaaagtacggctggcagccacttcgtctttgaaattatgcatatcttcaagggtagcaaactgattcgggataatagtcgaatcgtaagaaaccagtacattcagactgaaattctcgtcaggtagtacaatgatagaagaaccagtcgtttcatcccggaactcaattttagacttgataatataaaagtctttgacggcattttgttctactgttcctacacgttctatttcttgtacgtaatattgtgcactaccatctaaaataggaaattccggtccgttaacttggatcaggcagttatcaatgcccaatgcgtaaagggctgccataccatgttcaatggtgcttactttgactccatttttcgacaatacagtaccacgggtggtttctgttacattgtcggctactgcgtcgatagttggttgtccttctacgtcaatgcgttggattttatatccgtgattgtccggagctggattgaatgttacagtgagatcaagtccagtgtgaagacctttcccgctcagtgaaaagctatctttcagcgttttttgtttcagcattggttacttatttacttatttaatagttgttttaattcttctacttctttgcgcaagttacgcagttctttctgcatatccggcaggcttctttgtgcaatggatgatttgaaatattgcttcagttccataggaggagttccgataagctggctaccggacttgatgtctcccggcacacctgattgtgcgcctaatccaactttatctcctattttagcatgtcctgcaatacctacctgaccaccgatcatacaccattcacccactttggtagaaccggcaattccggcttgcgcagccataacggtatgcgaacctatttcatcattgtgtgctatttgtatcagattgtctaacttgacaccgctgtgtactaccgtagctcccattgtagcacggtctacacacgtattagcacctatatctactttatcttccagaataacaattccgatttgcggaatcttatcatatccgttcggagtgggagcaaaaccaaatccgtcagctccgatcactgcacccgaatgaaggatacattcattacctatgcggcaatcatgataaacatttacattggagtaaagcaggcaactgttgcctatcttcacgccgtctccaacgaaagtgtgcgggtaaatttgagtattatctccaatcacggtattttcaccgatataggcaaaagcaccgatgtatacattctcaccaattttggcgctgggtgcaacgaaagctaatgaatctatcccttgtttcttaggcttgctcatctcataaagattgagcaatttagctagactttcgtatgcattgtctactttgataagagtagctttaatttcgtgttcgggagtgaagtccttattaaccaagacaatgcttgattgtgtttcgtagatgtaaggtgtatatttgggatttgacaggaaagaaattgctccgggcattccctcttcaattttagcgaatgtgtgtaccgtagcgttttcgtctccaatgatttccccttggataaatgctgcaatttgcttagccgagaactccatgtcttttatttaaaatttaattagttcacaaataacggatttttttttcagatttccgtgttattgcatgaatattttatacttatctgtgtaatctctgatagcagagatagtatttctttacctttttggacaataatgagatgttcagcatgtccgatgcttcggcaatatttttgatagtgccgtctttgtagataatatcaatactgtcatctgccgggtcatacatattcttttcgatgctgggggtagagacaaaatagttcgcttcggaaagggttatgcctagttgctggctgatgtgcaaagttaattctttttttctgtcctcactaataggttccgacgaaatttccactttaaagatatttcggtttatcattcccgtgcttaaagtggaaagtaccttatctgtgtgggtgctccacactttcaaggctgtccatatatcattgtcgtccagctggataaaattctccagacagtcggggttgttatagaattccgttggattgatatcattgtaaaggaaaaagcgtaatgcaggagatgcaaacagttccactccttgtgaagccagttctttggcacgcaagagagtactaatcagcatcttttcgtatgccacagacgtcttatgcaggtatacttgccagtacatcaggcgacgtgccgtgaggaaattctcgatagaatagatccctttggattcgacaaccaaacggtcatccgctacatcaagcattttgatgattcgggcagagccgatgttaccttccgttacgcctgtataaaagctgtcgcggcgaagataatcaagtcggtccatatccaactgaccgcttacgagttgatgcagaaagcgtttcgggtattcgtccttgaagatttgaatggcaagactcagctggccgttcatctctttgttcatccgttccatcaacataagagaaatctcttcgtgcgagactccttttacaatcgtgtcttccagtacatgcgagaaagggccgtgtcctatatcatgcaacaggatggcggcctgcacggcctccgcttcactatcaaagataaaattgcctttggaggccagttgggtgatagcttcactcatcaggtgaaaagcacctaaggagtgttggaagcgggtgtgttgtgcaccggggtacacaacagatgataatcctacttgcttgatgcgggtaagacgctgcaaaaggggatgccgtactatatcgtacagtaacccctttggaatattgatgaacccgaatacggggtcgttaattatctttctttcgtaaggcattcgttttctttagagatcctttttcccttttcagagaattgctttgagttgttcagccatttgtgcttgcacttcttgtgcggcggtgcgggcagcttctgcaaatttctctgttttatctacgtagataataccacgcgacgagttaacaatcaatccgcatgtactgttcataccatatttgcaaacttcttcgagtgaaccgccttgtgctcccacgcctggtacgagaaggaaatggttcgggacaatcttgcggatgtcctcaaaagcacgtccttgagtagcacctaccacatacatcatgcggtcatcgccagcccattcctgtgatttgcgtaatactttctcgaacagacgttcgccgtttacgtcttctgtcaattggaagtcatgagatcctttgttggaagtcaatgccaacaggatcacccatttgccttcgtaggtaaggaacggagtaacgctgtcttcacccatgtagggggctactgttacagagtcgatatccaattcttcaaagaatgtgcgggcatacattgcagaagtatttccgatgtcaccacgctttgcgtcagcgatgatgaattgatccggatagttatctttgatatattttactgtcttttcaaatgcgatccatccttttacacccatgctttcatagaaagccagattgggtttgtaggcgatacacaaatcagctgtcgcgtcaatgattgctttgttgaatgcaaagatcggatcttcttctttcaacagatgttccgggattttcttgatatcagtatcaagtcctacacaaaggaatgattttttgcgctttatgttttcaaataattgttgcttatccatcttgttatttactattttgcaatttactatttactattttaagaaaccgttctcaactctcaattctcaactctccacttctctaaagttcgctttctttcaggcgttctgcattttccgctacgatcagatggtcgatacaatcctggatatccccgtccatgaaggctgccagattatagattgtatagttgatgcggtggtcggtgatacgtccctggggatagttgtaagttcgtattttggctgaacggtctccggtagataccattgtcttacgtttggaggcaatgtcatcgatatatttctgatgttctttgtcgtagataaaagtacggagacgggccaaggcgcgctctttatttttcggctggtcgcgtgtctcggtacattcgataaggatttcttcggcaataccggtgttcgggttcttccagatatagcgcagacgtactccggattctaccttgtttacattctgtccgccggcaccgccgcttcggaaagtgtcccatttgatttctccttcgttgatgactacatcgaattcttcagcttcgggaagcacggccacggatgcggctgaagtgtgaacacgtccttgcgtttccgtcgcaggaacacgctgtacgcggtgtactcccgattcatattttaaaattccgtatacattatcgcctgtcacactacaaacaatttctttgaatccaccggctgtcccttcgttcgcattggagacttccattttccaacctttggtttcacagaatttggcatacatacggaagaggtcgccggcaaagatagctgcttcgtcgcctcctgcacctccgcggatttcgagaatagcgttcttgctgtcttgcggatcggcagggacaagcatcagtttgatttcttcttccaataccggaaggcgctcttgactattgtccatttcttctttcgccatttcgcgcatttcagcgtccgattcattggcaaggatatttttagcttcttcaatattacccagtaattggatatattctttccttgctttcatcaagtcgtctaattctttatattctttagtcaacttgacataacgtttctgatcggcaatcactgccgggtctgtgataagggtagatatttcttcaaaacgggctacgagtccgtctaatttttctagtatggtactattgtctgccattctttaatatctaaattctccgaattcgctcttaatgattaattctgtttgctcgcatgcttcaacacgtcctacaatctgtgccgggataccgaatgactcggagatagctatcacttcttctgcatgttccggtgacaggtagacttcaaggcgatgtcccatattgaataccttgtacatttctgcccagtccgtaccgctttgttcttggatcgttttgaataaaggaggaacagggaaaagattatcttttactacgcgtacgttttctacaaaatgcagaactttagtttgtgcaccaccggagcagtgtaccattccgtggatttccgggcgcaatgcatcaagtaattttttgactaccggtgcgtatgtacgggtaggagagagtactaacttacctgcatcaattggagaatcttccacgctgtctgttagttttaacttaccggaataaactaactcttcaggaactgcagcatcatagctttccggatatttttcagcaagatatttgccgaatacgtcgtgacgggcactcgtcaaaccgttgctacccataccgccattgtattctttctcgtaagtagcttgtccgtaagaagccagaccaacgatcacgtcacccggacgaatattggcattgtcgataacgtctgaacgtttcatgcggcaagttacggtagagtcaacgatgatggtacgtaccaaatcgccgacatctgcagtttcaccaccggttgcatatacgcctacacccatttcacggagttcggccagcaattcgtctgttccgttgatgatggcggagattacttctccgggaatcaacagtttgttacgtccaatggtagatgaaacaaggatattgtctacggcacctacacaaagcaggtcgtcaatattcataatcaatgcatcctgtgcaatacctttccaaacggataagtcacccgtttctttccagtacatataagcaagagatgatttggttccggcaccatcggcatgcataatgttacaatattccgggtcacctcccaatatatcgggaataattttacagaatgctttcgggaagattcctttgtcgatgttcttgatggcgttgtgcacatcttcttttgatgcgcttactccacgcatcatgtatcgttgattactcatgagttatagaattattttgtatacggctgcaaaagtacagcttttttttggtacagcctagaaaaacagtcaggtaaattccagggtaaactttcgattataatacgactatgcgtgtaaagccaagattataatgcatattttatatgttcactccagattgaatcaatcagttttccgactgtggcatgacacctcaaactatattcactgatgtttatattgtacttttcaagcaatgcttttcttaaatcagcatactgaatttctgcaacatagaaacctgtattaagtgttattagttttcccttgcagaaagggcgaacgaaattgaatacatcatttttagaactgaattttctcttcttttgagctggtggaagtgtattgggaattgtagaagtctttctttcccatattgcattaacaagatttcctatggtaaatagattactgattgctttctcactatatgttaattcataatctttagctaagatttgaattaaaggatatatacgtaaacctgcagtgataatattggtgtcaagagttattaaagatcctgtacataaacttcgaaccaatccaaatacatcattcttgttcttgaatgttttgtttttatttgaatttactacagacgaatttcctgatgccatatttgtagatctgttgacataagacacttcttgtttgggtacgataggctttgattgagattgtgttttaactttttgctctgctaaaagattctcatattctttctgtacttttctagctttagtttgttcatcggacagacgtttttgtagttgtttgttttcctctatagaatacaataaacgcttctctttatcgagtaaatcattttttattttttcattttcttttttgctttctattatggaaaactctaattctttgattcgagaatctgattctttatttaggatttgcatctgcttgatttcaatcttagctttttgtatggcagattcattcttttttaaattttcagtcatactcttgcaatcttcagtagcctgcaaaagagaacgttgcaatcgttgattttcgatttctaaattactttttatggtctgcagttcactcaccatatttatactacgccaattggttcgcgctacagacaattgtttctcatccaattgataagtgttatttccatcaatgtagtataatataggaaaagtccaaccacatctgttgcaaaaattagaagatattgacacttctttatcacatatagggcatatcttggttgtatttcctatatatgtttgtttttcaaatatttgcttgactacatctatttgttgtaaagtcaaacgttgacagtcttttgccaaaacgctgatttcttcttttatcttttctttcttagcttcggcctctttctcttgtctaagcttttcttcttcccgttgtttttgggcaatatcttctttgactttattaatagcacggagcaaatcttttaatgcattttggggattttcttgataatcgatataatctaatggacgtatcaaaagtttaaatttcttgttgtactggctattatctatttttacaggaatgattgctttttctccatccaaagcttcaaatatttcgcctgcggtccacatcgattcgttcgaatgtttggaggatatgaatatgagcatcttagattcagctattgcgcctgtgataatttcaatgaactcttgtccactgtaaattccgtctttatcgaaccagtaggtaataccattttcatcgaatacattttggatttccgctatggcattaccaggtattacattgtagctttcatcaacgtaatctctgcgtgaatagcttataaaaacatcgtatttgtatttcatgttatattatatttcattggttcaacctaatatttatctactggcgtcagaattactgtgtttggtatattcattccaaatagaatcaacaagtttatataatgtagagtggcattttagagtatgctcaccaatatggatgttatatttttcgtataatgcatcttttagatctgtatattgaatatctgcaacgtaacagctaggattaagtgttaaaaaccttgctttgcaaaaggaacgaacaaaattgaatacatcatttttgttcttgaatgattgatatttctttgaatttgttgtagagaatttgtctaatattatatttcctatttctcttgcagaaggaacttcctgcttcaattctatattcttttgaactttcaaaaggttttcatattcttcttgtatttccttaactttagttcgctcatcaaggagatattttcgtaatgtctctatttcatccatagcattttgtagagcatatttattatcggtcatacttttatgttcttcggtagcttgtaagggggaactcttcagaggttgtttttcgggctctaaactgttttttattatactacaccaattggttcgagctatggataattgttcttcatccaaaggataagtgttgttttcatcaatacagtataatatagggaaagtccaaccacatctgttacaaaaattagaagatattgatacttccttgtcacatataggacatatcttggttgtatttcctatatatatttgtttttcaaatatttggttgactacatctatttgttgcaaagtcaaacgttggcagtcttttgccaaaacactgatttctttttttattttttctttctttgcttccgcctctctctcttctctaagcttttcttcttcccgctgtttttgagcaatatcttctttgactttattaatggcacggagtagatcttttaatgcgtttttgggattttccagataatcaatataatctaatggtcgtatcagaagtttaaacttcttattatactggctattatcaatttttacagggataattgctttttctccgtccaaggcttcgaatatttctcctgcagtccacatcgattcgttcgaatgtttggaggatatgaatatgagtatcttagattcagctattgcgcctgtgataatttcaatgaactcttgtccactgtaaattccgtctttatcgaaccagtaggtaataccattttcatcgaatacattttggatttccgctatggcattaccaggtattacattgtagctttcatcaacgtaatctctgcgtgaatagcttataaaaacatcgtatttgtatttcatgttatattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctctgcgtgaatagcttataaaaacatcgtatttgtatttcatgttatattgtatttactaaaatgtgacctctgatttatagtgcgaatatactctttttgagtggaataaagaataacaaagaaatattttgtgaaaaaaaagacgacataaagtagtgttcgatattagtacttaaaatagttgttgaaaatttgataattaattgattctctattgaaacagatacttgattatttccaagcgaatgctttaagattgcatcacgaatataatgatttaatgctgtaaaatgacatttgtgattaaatggaaaataaatgtacttttctattagaaaaccatgcttatctgggccatcttttgtaaaatgtgaggtggatataaataaaaatagtgggaaagtttcttcttttcccaccagctaaagatttatttatattgctaagtatctctaaatgtaaaatataaagatcgatttagcctctttttagaattctaccttcggagccttctcacttccttcttctgcttcaaaatatgctttcttatcaaagccgaacattcctgcaaagatatttttggggaaacggcggatattggtgttataagcctgtgcagcatcattgaaatttttgcgcgctacattgatacggttttcagttccttccagttgagcctgtaattccaggaagttttgattagcttttaagtccggataattctcggtaatagctaataacttgcccagtgctgatgttacagcaccttgtgccttttggtattgcgccaacttttctggtgtcagatcggcagcgtccactttaatttgagttgcttggctacgtgcggcaacaactccttccaatgtttccttctcatgtgtcgcatatcctttcacggtgtttaccagattaggaatcaagtcggcacgacgttggtattgagtttctacatttgcccattgaccacttacattctcgtccatagtaaccagaccgttatatacacttactgcccatatgacaaggatagccacaacggctaagatgataataattgacttcttcatgtttcttgtttttattgaatttgataatttgttttctacttattttctttagaaacgagaaccggcaccgccgccaccgcccattcctccgccaaagctgcctccaccgaaaccgcctccgcctccgaaactacctccgccgaagcctccaataaatggaccacctccgccacctccccggtggtggtaatcattatcataactttgttggcggcgtatgatggtatgtccgcagtttctacatgtataggtaacatcctcggttttcaccccgttaattcgggatacgacagcacttccgcttctctgtaattgatgtttaccacaattcggacaacggctttgtttgcgtgccgaaaagaaagcaagacctccgccaatagcaataaaacaaagaatggcaagaacaaaatcaaaagaaccaccgctgttcgaatcggagagagcatcattttccatagaaccgtcaagccgctgacaagtcgcttttaggccggccaccattccggcatcccaatttccgtctttcaggtaaggaatcatatatctggtttgaatccttttacagatcgcatcggggagcactccttccaaaccataaccggtataaaactggatacaacgttgatctgtaaccaacaaaataaccaatccgttatttttatctttcttccctacaccccatttattaagtaactgatggcagaagttgaaacaatcttcttctccgattgatggaactacggcaaccaccgtttcaattcctgtttgttgttccaaggcataaagcatggagtctatactgtcacaagctgcctgtgaaagtatgccggccgggttgcaaacatattgcattttgttttgcaggtgaacttttgggaggttgtccaccgtgtatactttctcttgagcttgtagtgggaacagaagaaaagtagctaatataaaagtcaatattgatttcataacgattattttacgtttgcaaatatagaaactttttctgttatgaatctaaaactccttgttataataggtttaatgaatgtatcgcccgacgaatgcacggactcggtcggtgtattcctgtttattctctttgtatgaaactgcatgagccgctcctggaacaatccatagttctttgggtcccggtttggcttcgtagagcgaatataccatccaggtaggcacatacgtgtctttatccccgtgaataaacagcatcggaagctgtgatttggctacttgtttcagtgaggaagcctctttaaaattccatccatatttcttctcgcaaagccagcttgtggtatacatgagtggaaaagggggaaggtggaaactagctttaagctcatgtgagaattcgtcccatacactggtgtagccgcaatcttccacaaagcatttaacaaatggtttctgttcctcaccggacaccatcatggttgtcgcacctcccattgaaatgccgtgtacaaccatttgtgtactatctccgaaaatctcattggcaatgttcatccattgcaatacgtcccaacggtctttccatcccatctggatggctgggccttcactttctccctgatgttgcaggtcgggaagtaatatgttatatcctaaatctcgattatacagataaccaatcataaacatacggatagcattatctgtatgtccatgcacaatgactgctgtcttactggtgggttggggagcagcaacataatacgcatgaagttgtattccgtgcggattgatgatgaatgtatctttcagtgcatccacttgtttcaggctgtccacccatggacgtaggaaagggtagtttctatacatgaagggataagagtcagcatctttagacaaaatcttggcattcggagtcaatgaaaagtttaacatataaaaacttcctccgatggtgcagccggtcaatgccagcatgataataatgatgctatatacaacttttctcctcataaaaactctctctaatccttatttatgccatatctcccatgcggcaaatgcctggagcagcagcatttccagaccgtttttaacaacagccccttgtgcttctccttttttcatgaacagcgtaacattcggattatataacaaatcatagagcaaatggtttggagtcagtagctcataaggaatattagggcagaaatctaccttaggaaacatacctacgggagtacagttgacgatgattgtatattctgccataatttcgggagtcagttcctcataagtcagcatatcatcggctttgtgggtgcgtgatacgaatatactttcaatacccaggtttttcagcccgtggtagacggctttggaagctccgccggtacccagaatcaatgctttttggtgatgaggctgcaataaaggttgaatggattgagtaaatccgatgatgtcggagttgtagccaaccagtttgacttttcctttctgctggcggatgattttaatgacattcacagcacctatctttgcggtatcacggtcgagttcatccaaaaaaggaatcacttgttctttgtaggggatagtcacattaagcccgcataaattgggattctcttcgataacttccatgaagttattaatgctgggaatttcaaaattcacatactctgcattgataccttcggatttgaatttctcattaaagtatccgatagaaaaagaatgtcgcagagggtagccgattaaaccatatttttccataatcatttattgcttagttgggttattgggtttactttttagaagacgtactatttcttttactttaccgtcagggtatttgtctttatagtattccgtcaaatcttcgtatatccagaaattataagggcggccgataaagatattgaaagtgttagatgacttctcgccgtcaatgcctaatttcaattttatatggttgtatatttggtcgtcaggaggaataagtctgcaagttttggctatttcagtcgttattccatacataccatgagcttctgcttcttcgattgcgaattccttttttgttataggaaagccatcagaattgagtaatgtatatgtaccggagttcttttcctgaatagatatactgtatgattctccattggtatagggagatttactctctaaatcggcttttattttttctttaatttcgtccgtttctacatctatgccatattctacggcaacgatatcgaatttctgttcagattgagaggggggtctggtaattactaaaccttgtttctggtcaatttcttgtccgttcaggcagaatttccggtcgaatacgggttctttctttgatttccaggtcagtttactggaaaaagtgatgacagatggttcttttccatcattccagtctatttctactttctcattatcgaatgtatgatcgccattgaattctccgaaagtcagataatattttccgtctttgcttactcctgtttgcagacctgtgaaataggccatataagctctggtgcgttcgtttagcggagcatctttttcgtaagtctcccctttgtagatcgcttttattccttgattggcaatagagcctttggtgagtggattcagtaagtcattgccttgagcatcctgtactgaaatgtaaagaactatgggagcaaaatcccatattaggtcatctcctccattgtttgccggatcacaagaggtgaaattgatacaacaaaaaatgcagagtagaaatagtccaattgattttgttgttttcataaggttacattattaggttatttggttgcggtataaagagtgcagataccaaaggtcagccgtttgaagttgacttcgctaaaaccggctcgggcgatgactcctttcatgacttccccttgaggaaatactttgatggtgtccggcagatagcggtaggcactgttatctttggatagaagcttacccaataatggaatgacgattttagagtagatggaaaacagttgtttcatcgggaagcggtccggagtggtaagttccagaattacaagatgaccgcccggtttcagtacgcggcacatctcggagagccctttgtcgagatcttcgaaattgcggataccgaaagctacagtaatagcgtcaaaatcattgtcggcaaaagagagtgaagtgcagtcctcccgggcaaaagatattttatccgacagtccttccttttttactttttcacgtcccacattcatcataccttccgagatgtccgtgccgattagttcggcaggttgcagtttgcggcaggcgaggatggcaaaatcccctgtaccggtcgctacatccatcattcgctgcggttgaaaagggtgtaaccaggcaatagcttttttgcgccagctgcggtcgatacctaaagataaggtatggttcagcttgtcgtaggcatgtgcgatgttgtcgaacatacgttccacttgctcggtcttttttccttcttcgtcgtaaggcttgatatgttgttgcgggtaatccattttttagttgatagttgataaatgatagttgatagttgaagaagatagttgataaatgatagttggaagatgacagagttaatagttatatgcgataagctgcatattaactatcatttatcatctatcaactatcatttattatctgtcatttatcgcttatcagctgttcaaaaaagtttcgacgtttttgaatatacgttcagcgatattgctagtatcttctttcacgaatttctcaccggtgatgttttcgaacaattcgatgtagcggtcactgatactttgtacgatagccggagtcatttccggtactttctgaccgtctttgccttggaagccgttttccatcaaccattcgcgaacgaattctttagaaagttgtttctgcggttcgcctttttcgaaacgttcctgataaccttcagagtagaaatagcggcttgaatccggagtgtggatttcgtccatcaggtagatagtgccattgtgcttaccgaattcgtattttgtatctacgaggatcagtccgcgctctgctgcgatttcagtaccgcgtttgaaaagggctaatgtatatttttcgagaatttcatactcttccggagtagccagtccttgttttaggatttcttctttagagatgtcttcgtcgtgcaatcccatttcagctttcgtagtcggagtaacgatgggttccgggaatttctggttttcgcgcattccgtccggcaacttcacgccgcaaatttcgcgtacgccgcttttgtaagtacgccatgcgctaccacacaggtaaccgcgtacaatcatttctaccggaaaaccttcacacaatacgcctaccgttaccattgggtccggagtagccattttccagttcggacagatgtcagtagtggcatcgaggaatttagctgcaatctggttcagcatttgtcctttgtaaggaataccttcaggaagtactacgtcaaaggccgaaatacggtcggttgctaccatgacgagtttttcgccgttgatgttgtacacatcgcgcacttttccgtggtacacgcttttctgtcccggaaagttgaaatctgtttttgttaatgctttcattgtctttattataattacaaattacaagttacaaataacaagtcgcaataggattccgaatctaaagacgattagtctttggccagtttcaccggacgttcgccgttgataaccagttgttcgtttttccgtttctcccgttcggctttcgcttctttgtcgaatttttcgtaagcatccacgatacgttccaccagtttatggcgtacgatatcttttttattcagttcaacaaaactgatacctttcactccctttaagatgcggagagcttgcaccaatcccgatgtttgtgaagcggggaggtcaatctgtgtcatgtctcccgtcacaatcattttggtgttcatacccatacgggtgaggaacattttgatttgctgtgtggtagtattctgggcttcgtccaaaatgacgaccgcatcattcagcgtgcgtccgcgcataaaggctaacggggcaatctggataatgttcaattccatgtattcctttaacttggcagcaggtatcatatcttgcagggcatcgtataaaggttgcaggtatgggtcgatcttatctttcatgtcgccgggcaggaaaccgagcttttctccggcttctacggcggggcggctaaggatgatttttttgatttctttattcttcaatgcacgtacggcgagggcgatagcggtgtatgtctttcccgaacctgccggaccgatggcaaataccatatcattcttggcgaatccttctaccagtttcaactggttttcacttcgggggatgataggttttcctgtgacactgaacacaatcacgtttcctgtctgttccgcttgcggcgcatttccttttataatgtcaatgataacttcttctttcagtgaattatattcggcgcagtacttttcaagtttggtgatattttcttcgaaagcacacatttcttcctcgtcgcccagcactttgatgacattgcctcgggcaactatgcgtagctttggatataaagctttaattaactgtatgttggcgttgtttacgccgtaaaaaataaccggatcaatgtcctcaagaacaatcagcttctctatcattaagttgtattaaagaaaaatttctgcaaatttaatgaaacgttttggattctctgattgtttggaggtgaattttactgcaatttacattcatcttccgttcatcgggcagtaatatggaaacaaccttgcttcagttcgtatttgatatagcatttttcagcttgtcgtagatctcttaaaacttcggatagaacaagtttcagtgtgtcggcactcacgtcctgcatagggcgaccgtctttatcttccactttcttaaaacgtttccaactaacatcaaaagtagccccgaaacaatgtgccgagttggcggaggcatttccattgcgacggcggagacgtttcacatcgttttcagtacgtagtacggaggtgatgattacctgattgggattcagccctttggcagccaatgaatcgagaaagttggagccgattgtatcgagcaatgcgctggcacgtggaacgaggtagggaatggaatgtgtcaatgaatccactgcataaaattcattatcagtgatatgagtcaacttttctttcatagcttccgcttcttctcggtctgccagcgggctaatacctatctttttagcgacttccagatgtgcatcgttcaaatcagggaaagaacgtttgtaactgacaacgccacgaatattgtgcggcttgttcaatttcagtgacatgtctttctttttgcagcttgaagtaagcgttgtaagcccaataacaagtaaaaatagcggtaatatgcgaagcttgtaagtagtcattttgtattttttgcccgcaaatatacgctattttttcatacgttctatgctttgcattattttccgcctcatatcttttacgggtcactctaaaatattttccggtatttccggacgggtatcaagagtgcctataatggtataatccgtgttatctattgttgtcttcagcgttggtattattaaataatcacttctagtaagagccttgttaataagttgctcccaatctatctttaaatatctttgtataagattgataactgcatttacacttgtaactccatcaaatagttcaaatcttaatttgtgaggggtgggaggggttgatgcatccgtgaaatttccttgttcgtcagatgcataatttaatgttaaataaggtatggcgtatgtaggagatgagttgccgaaaccattttctaatttgactgaaaaatcgtatgttcctttggctatcggattttgggatagttcgtttttggagtcgctatatcggaagaaatagcaatctttagattcattgttaatcaaatagaccacagtgccattggacagtgccggatgattactttcttttattgcgtatgccaaataactgtctataattttaatttttaattcaactatttcgttggtgatattatcttttactttcacctttgtttctcctttctttttgggggtaacttttaaacttcccattcctattgagctggataaatctacatcgatgcttaaaatatcagtttcttctacagtcacggtatagtctctgtttccacctctaatggtaatatctgttgctcttaataaaggttgttcgtaatactctttttcaaaggataaaggatatatcttttcttcattattattgccacagctaaaaaagataattgtacagaggaatgaaagtagtgctccaagtaaatgttttgttttcatgattattttgttttatagttttgcaggagagatatagtcttataagttcctgtgttgacgttggaggcaaatataaagattttatcgatatgttgaagtaaatagtgtatttatttcctgtcctccagctattttcatacatttgtagcggtttataaaaataggccactttcccactaaacataacacacatgaaaacagatttcgattacaattctatgcccgttagcttcgctcattgcttgaatggacattgtttgcgtgcggacaaatgtttgcggcgacaagtaactctccgaatgccgaaacagcgggctgctgtaatggttattaatcccgaacatgtcacttccgatggtgtagactgcacttactttattgatgaaaagccggtgttgtttgcacggggtatgaaacatttgctggatcgggtgccgcttgctgatgccaccgttatcaaacgacagatgatagcctactttggcaaaacgatctattaccgttgttgcaacaaggagcggctgattaaaccgaaggagcaggaatacatacagggacttttccgcaggcggggagttacagaaacgcctcaatttgacgaatatatagaatactatgatcttgggtaagtatatccgttagttccggtagtcccacatattgtgggaaagtattcttttatattatgggaatttattcccgcaaaataagggaataaattccctccagctagggaatcttttcccataatatatgggactaccggagactgtaataccctgataatagttgactgccttttttcttatcttcgggttgggttgacatttattatgtaggtattatatagcagtcccggtatgagaaatgcatgatgaaagtatgagaaataccggttttttatgacatttcaggcaaaatattatgagaaacagctttttgaaaagtatttctcatagtgctattgctttgaattacaggtaattattctatggattatgagaatatgagaaatgattttgcaaaatcatttctagtggcgcgacattccgggattattgtaattgtatacaaagaatgagcgatatggcttcacgacttattacatattttgtgttacatattttatgtaacataaagaacgtaataaatccggaatgttcaaagaagatttattcgagttatatataaaaaacaaacgctgatgagaacaagtaatcatgcttttctcatcagcgtatattatgttggattacaactatttcttatcttttttctcgtcagcttttgttgcaggcttttcctccgttttgctttccggattgataatacccttcactgtttcaccgataggaagcttgtccaatacgccaaggctcggagctactgtctttactaatgtgttcaggaaattgctagttccaccgtttcctccgtcgaatacagtgatatttcctaggttcatgtgttcgaacgccttcacctgttcgccggcgatttccttccactggtctaccatcttatattggatagcgatagctggattcgattcagctgctcttaccattgcttcgaaaccttctgcttccgcaagtaatgatttcttcttaccttccgcttctgcttccagtttcaattggatagcttttgcttccgcttcggcttgtgctaaagtagcctttgcgcgtgcttccgcttcgcgggtaatcttttcagcgatggcatttgcttgcaggatagcttcctgtctggcgatttccgcaggaacaatcttttcagccttcaatgaagattccactttccgtgccttagcttcttccacttccttttgcgcaatttcgcgtgcagtttgtacggcagcttccgattttgcggcagcttcacctgcttgcttatcggcattagcttgtgttacagctagttctgcattggagagtgctacctctttctgtgcgtcatttcgtccgatggcagctttcttggcagcttccgcctgtttgatttccatatccgagtttagttcggcaacacggctttctttttctgtatttgcctgctcgatacggatattcttttcagcttcagcctttgctacttgtgattctttttctgcattggcaatggctacttgtgagattctgtccttatctgcatttgcaacggagatttcttgtagttttttggtttctgcaatagcaatatcctgatctttgcgggtttctgctactttcgtttcacgctcctttatttgattagcaattttgatagcacccagcttttcctgttcttcgatgttagcctgtgcctcgttcagtgctttactttcagcttccttacctaaattgacaatgtagttggcagcatcgcgaatatcactgatgttgatgttcatcagatacaaaccgaatttgcgaagttcagtatcaatattatctttcactttagccaggaacttatcccggtcagaatttaattcttcgatagtcatatcggcgatcaccatacgcatctgaccatatacaacatcagtaattaagttctgcttgtcatccatcgtcagacccagcatacgttctgcggcattctgcatcacttcgggatctgtgctgatggctacggtgattgtagtcggcacatctacacgaatattctgagcggatagcgcaccggtcagtttacattcgatctgcatgggtttcatggacaggaattcgtagccttgaataataggccatacgaaggctgcaccaccgtggtatagttttgccgactttttatctcctcccgttttaccatatacgacgagtacctcgtcactcttacatttgcggtaacgggaaaggataccaatgaaggtaagcaaaatgactgccactaatatagcagccattatcaacatttcttgtgtcataaaattatgtatttgaatagttattgaatgaacagtgttccgtctttgtaactggtgatgattgttcggtctccagtctggtatgtttttccggattcggagatgacgtctacttcacgcatggctccgtcccgggtggtctgtacagtatatttgctgtcgctttgcttgaagtagatggtacattctcgtcccacaagttgatctgtctgttcagaatgatttacttgttgcagttgataagctttcttatagagaaaccacacagcgagaacaaagaaaagacccaccagaattccgatgacataactttgaatttcagtgtttcccgctaaatacatgtaccagccgaatccgattccaaaatgagttagtcctttaaaagaaactacgctactgatgtcagcatctacgtctacatctgcatctatgtctccgaaaaagatggatagaacgaattggattacaaatattcctgttgtcacaagggcaataataaggaaaatggtactactcataattgtgaggtattagtgaatcatgattattttgttctccaaatatacaggtttatgcgaattatacaaagataaatgagataaaatgactacttttgcgcgcgaaaaccctaaaaaagaggaattagcgtgcaaaggtattttatttatttggcttacgacggaaccaactatcacggttggcagattcaaccgaatgggattagtgtgcaggaatgtctgatgaaggcattgtctacctttctgcgtcgcgaaattgaagtaataggagcaggccggacggatgcgggagtgcatgcctctctgatggttgctcattttgattccgatgaactgttggatactacttctgtaactgataaattaaatcgtctgctacctcccgatatttccatttatcgtgtttgccgggttcggccggatacccatgcccgttttgatgcgactgcgcgaacttataaatattatgtgacgacatcgaaatatccttttaacaggcaatatcgctggcgtctttataaccagttgaattatgaacgcatgaacgaagcagcgcgtatccttttcgagtacaacgattttacgagtttcagtaaacttcatacggatgtaaagaccaatatttgtcatattactcatgcagaatggacgcaggaagaagatgctacctgggtgtttaccattcgtgccgaccgtttcttgcggaatatggtgcgagccattgtaggcacgctcattgaagtgggacgcgggaaactgactgttgaaggtttccggcggattatagaacagcaggaccgttgtaaagccgggacatctgctccggggcaagccctgtttctggtcaacgtggaatacccggaaagtatatttgaatgtgatgaccagcaatcatccataaccggcgaaccgtctgtcgctgataacttataattggtaattagtaaataataaatattctcatgtggttattattagcattcctctcggctactttgctgggcttttatgatgtattcaagaagaaatcgttgaaagataatgcagtacttcctgttttgtttctaaatacattcttttccagtctcatctttctaccgtttatcctgatatccgtttatcaaccggacttgttgggaggaacaatattcaatgttcccgttgctggttgggaacagcataaatatattatcatcaagtcgttcatcgtattgtcttcgtggatattcggatatttcggaatgaaacatttgcccataaccattgtaggacctatcaatgccacccgtccggtgatggtgctcgtgggagctatgctggtattcggtgaacgattgaatctctatcaatggattggtgtgatgctggccattgcctctttctttatgttgagccgttcgggaaagaaagaaggaattgattttaagcataacaaatggatcttttttattgtactggctgccattacaggtgctatcagcggattgtatgacaagtatctgatgaagtctctgaatccgatgctggtacaatcctggtataatgtttatcaggtgtttattatgtgtcctattctgttattgctttggtggcctaaaagaaagtctaccaccccgtttcgctgggactggacgattatcctgatctccattttcctttctgctgccgattttgtttacttttacgcattaagttacgacgattcgatgatttctattgtttcgatggttcgtcggggaagtgtggttgtttctttcactttcggtgcgcttttcttccgtgaaaagaatttaaaaagcaaagcgattgaccttatactggtgttaatcggaatgatattcttatatttggggtctaaaagttaaaacagttacacaagactgtttgtcataggttaaataagatagatatgaaaataaataaacttgttattactatattcttctctgctgtcggactttttgtttcgactgctcttcaggcacaagaggccaaaacgttgtttgtgaatatgccggattctctaagtcccttgcttacaaaagtgaatcgtgaagattgcatagactttctggaaagtaagatgaaagcgcaagtagaaaaccgttttggcaagaagtcggagatgactgatcttagcaaagactatatccgtatgcaaatgtcagctcaatcgacctggcagatgaaagtgttggcattaaatgattcaacgaacgtaatctgtacagtctctactgtttgtgctcctgcctgtgatagcagcatccatttctatacggacgactggaaaccgcttacaacatctctctttattaccctgcccctgatggatgattttctgaatgctcccgattcagcaggagtttatgagtttgatgaagcacgccgttcggcagatatgctattgatgaaagccgattttaataaagaaaatacggaactgacacttacgttaacaacccccgactatatgtcaaaagaaacagcagagaaactgaaaccgtttctccgccgccctgtagtctaccattggaaaaatggagcattctcaatttaataagcattcgttgatgaacgctatcatttccggtgtgtttgcttccacactttgaagtaatttgaattgtgctttggtgcgaacgaggttatgttccggatatttgattttataataagtatctccgttgatataatctgccaggaaccgtacacactgcatgtatgggaataaagccgccgcataaggaagattctcaatctcgatctgagtcaggaatgatttggctcctttcagatagcccttggtaaatgctttgaatatttccatattgaagtttacacgatcaaggtctttgtcgtcttcatcacctgtgttggcacctgtacgtaagaagtcaccataatcggagaatataaagctaggcattaccgtatccagatcaatgacacaaagcactttaccatcctcgtcgaacatcatgttattcactttcgtatcgcaatggcaaacgcgtttgggaagtttcccttcacgatataaacgttcagccttacacatttcatctgcgcgtttctctatttcatccagatagtacttcacttctgctacccgtccggcagcatccttcgcaacggcttcacgtagttgtttgagacggaactccatgttgtggaaatcgggtatggtttcacccaatgtttccggaatatcggccagcatagcctggaagttaccgaaggcttctcctgcataattggaatattcgggatttaccgtctcatacgtttttgcacgtgggatgaataccatcacacgccaataactgtcaccgtcaaaccagtatgttttaccttcttctgtttcgaggaaactcaacaccttgcggtctatatccgattctccggcttccgtcagtttcttgcgaatgtgattggtaacagcgctaatattggattgaagcatttctacattctggaaaatggcatgattgatgcgttgcaaaacatagtcgggagcatctgcttctttggtgtttactttataagtgtcgttgataagtcctgcacccaaaggtttgatttcttctatcgtaccttggactttaaatttagctacgatgctagataaatctttcatgttttttttctttaaaaatttatactaaggttatcgataatcatatttagcagcttcgttggcctggttagccgagcgaacgggtactaatgtgaagccccactggtaatcacggttagccgggatctggtggaaaggttccgggcgagcaccccaactgtcatatccgcctactccttgttgcttcatatctacacaaacctcaacgaaatctctgggagtgatgtcgttgacatgatgcattctccgtaatacgttgcgggcagcgttctcgtcgtgattggcaacctcttccgggctgaagttattccattggtaagggtggggcagagcttcttcagagtcaaagtcttcgatagagttgcgcaaggcattgaaaccgataagactgtccgctaccaacaccaggccgtttcctttattaggagataaagcgatccaacgggtatcagtgtgatgtccgttttcctgtggacgcacatagttgaagtacatttgatccgctgttgtcttatatacgccaacgagcgttccgtgattgcggtcgatataattctcttccgggccacggccaaagtattgtacattgttcatctgtgccggcaagcggaaacgcacaccgatacgggggacttccagtttggaggcagccttacgggcagcatcacttccgggggtaaatgtagccatgcgggtagcttcggaaacttctgtttctgtaggctgcatatccgttgatgtgaatttggcatttacgttaactattccgttcggatagattttgtaagtgacaacatacaagttgccggcagccagtaagtaggttacatttaaggagactgctttatcttctgctgtcatggtggcatccgttatgcggaagtttttgcttgattgtttccatacctgcaaacgtttaggagtgctgttaccatagtcattatcattaggagcacgccagaagttaggctgaataccaaatccgtctttgaaatattctgtaccatctactttatacgaggttactaatccgctattcttgttgaatacaaagtttactttggaggaagaaacgattaattcatctccttgaatcgttgttttcaatgccggaccgtttgctttatatatactcttctctgcctggataggaagttggaactggtcgtatgcaatttcatatccggttggaatcaacggttcaggctctgtggttgttacactgaagttgacaaaatattctgttcccggttgggctttcagaccatttaccggtacggtgaattctttagaggcttgcggagcaatatccaaagatacttttccaccttttattgtctttccgttagcaagtacattgtagtgaatctgatattttttcaggttagtgaaatagaaacggttggtgattttgaatataccggctgcggcatctactgcttcaaaacctacattctgatgtacatatttcacttcagccattgccggatgcggaccacgatccggattgacaagaccgttgcagaggaagttaccatcgctaggtgcgtctacgccgaagtcacctccgtaggcccagtattctcttccattcttatctttttggagaagaccttggtctacccagtcccagatatatccaccttggagattcggatatttgtaaattgcctgccattgtccccacaggtttcccgtggagtttcccatggcatgtgcatactccgaaggagctacaggacggtcgctaccattctttccgatattttccagccagtcggcacccggatattgcggaacatacatatcggagttccattcccattgagcacgttcgtagttgaccggacgatccatcagatctttgtctgcctctttcaaccacaaataagtctgatagaaattatatccgtttccggcttcatttcccagcgaccagaatgtaacgctcggataattcttattacgttcaaacatattgatggtacgatccatgtgcggtttcagccattcgggattgttacccagtgaaccgcctttccggagatcataatacattccgtggctttccacgttggcttcatcatatacataaagtccgtattcatcacaaagctcatagaaacggcggtcttgcggatagtggcaaaggcgtacactgtttaagttatgttgtttcatcagttcgaggtcacggcgcattaaatcctctgtaacataatgacctgttgacggattatgttcgtggatatttacccctttcagtttcagaggctgaccgttgatgaataagcagacatacggttttccgttagcagccttctgttcgataggcttgatctcaatccggcggaatcctacattgaaaggaatgatttcattgattttgccattctcttttactgtcatcaacagtttgtatagattcggatgttcggaggtccatgtgctgacatctgtcagattcttatcgaaagaaagtgtacgtacttcgttcgatggaatataggctgtcttctcttcagtagctacaacttttccttgtgcatctaatagttcataaactaatgtaagattagttgcagccttttcgtgatttctcaaatcgacatttaaaccgaagattccatttttgtaactgtcgtccagcgtagacttaattcggaaatctttgagagctgctttaggctgtgaatacagaaaaacatcgcgttcaataccactcatacgccagaagtcttgacattcaagataggaaccggtgctccaacggaagattttaactgtaagtatgttctttcccggcttcacgtaattgttgataagaaattctgccggattcttggagtcttcgctatatcctacttcttgtccgttgatatatacatatacgccggacttagctcctgccaaatgcaagtagatatcccgcccgtcccagtctgccggaatatcgatgtcccggcgataaactcctaccggattggcttcgggaagagtaggaggttgtggattgcgcggtttgaattcataaccatgattggtgtagatggctattccgtgtccttgtacttcccagttgccgggcacctgaatatcatcccacgaatctgtattggtgttcggatcggtaatgttttcgggaagttttttataagagtctacaaagtagaatttccaggttccgttcagcaagcggtaatacttgcttcgttcgaacttgccactcaaggcatcagcgcgattgttgtatgtcataaaagaagtacgtggatactctttgttaacttcaactacctgcacgtcctgccaataaggtttcacggctttctcagccattgtactaagtgttgtcagggaaaatattcccatgaaaatgcctgttaataagttgggggttggtcgaaatttcatgtttctcaatattggtttttcatttcttttttattttactttaatatgatcgaatccttctccatatactccaatgacagcactttgcgatacaaatgcattcgggtctatgtcttttattaaccggaagatgataggcgattcccttttcttggctaatacaaacatcatcttaacttctcgtcctgtataaaagccggttgcattgataatcgttactccccggtgtgggtattcgttaatatgccgtcctatttcttcatatttgttggatatgataaagaactgtacggattgacgggcgctattcactacctggtcgagaacgaaactacaaatataaagagttacaaacccatacaccactttttcccagtcttttaagacaaaataactggaagaaatgataatcatatcgcagatgagcacgactcttcctaatgtgatgtcccggtatttgttgatgatggctgcaataatatctgtacctcccgtacttccattagccgaaaaagcaacacctatgccgcctccacagaaggatgctccgatgacacatgccataaagggctggtcgtggagaagcccgaaacctgccgtcaatttttgaatgacggacagaaagaaggtgagggtaaatacaccaaaaatagttttgatgcaaaactttagtcccagcaacttgagggccagtagtagcaagaagaagttgatgctgaagtacgtatattgtaccggaaaacctgtggcccaatatacgatagaagcaatacccggtactcccccggtggtgatatcgttaggcaacagaaaaacggtccaaccgataccatacaaaatcatgccgatggcaatcattacataatctctggcttcacggataatgctttgcttagaaggctttggaatagctgttttcataaacgtgattatgataatctataaaatgttcaaacacgaacccatgaataatccggctttagaggagaagccggattggttcattatgctcgtgctaaaaggaaatatgctgttttattttgcaaaagcgtgacggtagccttgtactttattccatccgccgcgagtgaagtcgggtacttctaccggagctgaattgttctcgatagaaagtctggtaaattcagccatgcaacaccattctgccaggtcataaacgtccatatccaatggcagtccattctgcaagcaatatgccagacggtagtccatgataaagtccataccaccatgtccacctactttcttggctgtttcttccaactctatatgaataggatctttatatttatccatcaaggctttttttacgttttcaggtacagaaccatgtgcattcagattctcatgattaggcacatcttttgaatcaacttgtgaaggtcgcaggcaatattcttcaatcggatatttgcttgcgtaaccatcggctcccactatctgatacatacggctgtatgggcgtggagtcattacgttgtgctgaatcaacattgttttaccgttctctgtgcgaatcagggtagaagtctggtcaccattctggaagtcagtcacctcttctcctgtttgtttcttaatataagccggtccgttgacagctttcgtatccatcgataccaatgttttcatgcggtcaccacggtggatattaagtacctgacaagcagggcccatgccatgggtagcatatacatcaccgcggtgtagatgattataatccattcgccagttattccagtattcaggccagaaatcttccagattatggatatatgaaccttctacatgaagtacttctccgaatacgccttgttgtgccatatttaaagaagtcagttcaaagaagtcatatacgcagttttcgagctgcatacaatgcttacgtgtcttttcggaagtattgattagctgccagatttcatccagtgtcatggcggcaggaacttcgatagctacatgcttaccgtgttccatggcataaacacccattgctgcatgatgtttccagtcggtggctatgtataccagatcaatatcgtcccgttcacaaagttgcttccatgcctcttccgagccactgtaagaagcaacttcaggaagtccggcattcttcaaaatttcttgtgatttttcaacacgttcgggaagcaggtcgcataatgctacaatcttagttcccgggatatgggtccagcgtaccacggcaccaggaccacgcattcctaatccgatgaaaccgacacgaacggtatcaattttaggagtaacgagttggattacatcttcttgtccggcagggcgggcaggagtttctactttgataggagtaaaggcttcgggagcctttggttgtagagtacaactggtgtgccaagttaacaaagccaagccgatagccgtgactgtaaatagtttcttcatcatattttaaagtttttaataggggttattcgatgtttttcatttacgtgtcaaaaatagtaattaattagccaactatttatatttataatcgatattttcatcataaaagtttctattatgaggtaaaagatgagtctgactttttctacctgattttgtgtaggcttatgtgatgtcaaatacatataaaagacatgccataaaaaggctcttcctaaaaagaagtcacctttttagaattgcttaacgtttactgctcctgttggggtaaactacctacttcgtctgtacttctgatagaacctagtatttgtattttttccaggctcccctggtgaaatccggtatttctactgccatgctcttattcagtacagatttttcacttagttctgtgatacacgaccattcggctgcatcgtatacatccatatccagtggaagcccgttgcgcagacaatgaataaggcggtaatccataacataattcatttcattgggtaggcctctgcgatgtgcttcttcgccaatggttgcgctaaaaggatgtttatagcgtgccatcattttttctagcagttctccttcaagtggagtgtctccattaggatctagggcgatacaggggacagggtatttttgggcgaatcccagtgtgccgcatactgtttgaaggcggctgtaaggacgtggggtggatatgtcgtattgaagcatgattgtcttccctttgagcgtgtggataagagtggtgtttacgtctcccaattgatatttctggtgggcttccggtgaatattcgccgaatagtctgcgggcatactcgctcattcctgcctgatgagtagacatggacacgagatattccattctgtcactgcgatgaatatccagtatctggcaggcggggcccaacccatgagtgggataaggattgcctgtatgttcgatgctgtatctttttccccaatggttgtgatagccgccttcgctctcttcggcaaagtacattgaacgaagatcgtgaatgtaggctccttctacatgcatgatttctccgaacaatcctcgttgggccatgttgagaatcattagtgcaaagggatcataacaacaattttcgagcatgatgcagtgtcgcctggttttttctgcagtgtctaccaattgccaacattcttccacgctcatagcagccggaacttcaatagctacatgtttattgcattccattgcgaaagttgccattggagtatgcattaaccagtcggtgcagatgaatattaaatctacttcatccgattcgcacatcttcttccatccctccactccggtatatccggtggcttcggaacggtcggcttcttttaatagttgttgggccttacttagatttccttctcttatttcacaaagagctttgatttctactccttcaatttgcagataacgttgtaaggtgagcaatcctcgattgcccagtcctataatcccgatgtggacagtggggatagggggatgtgctagtcggagtacatgcgattgtaccggagaatttttcataagcttagcggtctaaaataaaacaaaaaaagagaatctaatttctcagattctctttggagagcggaagacggggctcaaacccgcgaccctcagcttggaaggctaatgctctatcaactgagctacttccgcaatttttgtgggcaaagatggattcgaaccaccgaagtcgaaagacagcagatttacagtctgccccatttggccactctggtatttgcccttttttgcttttgaggaggtttgtttctcaattgcggtgcaaagatacaactatttatttaaactccaaacaaaatcgatcatttttattgcagtaattgcacattcatctcctttgttacccagtttgccaccggcacgatcctctgcttgctccattgtatttgtggtaattaatccgtaaataactggtatatcgccagttgcgtttaattcggtaattccttgggttgctcccatgcaaacataatcaaaatgtggggtatctcctttaattacgcaaccaattgcaataattgcatcaagatcgcaattttccatcatttggttggctccaaaagtaagttcgaaacttcccggtacagttttcaccagaatattttcgtcttttgctccatgtttttttaatgtatcgactgcgcctttcagtaaagcaccggtaatattgaaattccattcggatacgacgataccaaatttcattgcttctgcattcggaacggaattgaaatcatattcggataagttatggtaagctgttgccatagttaattaaaagttgagaattataaaatgaagatttgagagtatgagagatttaagaagaaaggcacggatttcacggattccacggttttaatagatagtccgcttaatccggtgtaatccgtgcctcgatttccttatataatagatggtatattattttttcatcaatttagcttgctcgatatatttgtcgatgtccatagcctgataagattggaaatatttatccttgatcttagtgtaagcgtttacagcatcgtcatattttccctgttttaccaggatttcaccagcttgtatcaggaagatcgggcttaatgtgttgttgtcagctttgtctgctgccgacaataaagtagaagccgctttgtctaattggccaagttgtgcgtagcagttacctgcagcacccaaaattgccggagcaaccatttggtcttttccattgaagctgtccagcatcttcactgcttcttcatatttgccaagttgtgcgtagcaaataccagcataagcttttgccaaattggcagcttttgttccgctgtagtcatcagcaacttttaggaaacctgtataaccgatgctgtcaccgttcaaagcctgttcaaaagcatcctgttcaaagtattcctgtcctttgaaaagagctgcctgtgctttttcttcacgtggttcagcatagaggtttttgtacatgataaaacctgctacaataataatcacagcaacaacactgccaataattgcgtttttgtacttgataagaaatgcttccgattgtgtcagtgcatcttctacgttcagatgttcgttctgattcttttgttctgccattttatatgattctttttgttattattcacagtttgatatttcgactcgcaaaagtagtttttttatatctacaaacgaaatttagaagcatctttttttgttttacacccgaaaaccacgaaaatcttgctacttttgtgaacaaattaacgtgtacacaatgatactgaaacgaatatccatattaaactataagaatctggaagaggtagaactgggattctctgctaagctgaattgttttttcggactgaatggaatgggaaagacgaatttgctggatgcggtgtatttcttgtctttctgtaagagctccggaaacccgattgattctcaaaatattcgtcatgaacaagattttttcgtgattcagggcttttatgaagcggaggacggaactcctgaagagatttattgtgggatgaaacgtcgttcgaagaaacaatttaagcggaataagaaagaatatagccgtttttcggaccacatcggttttctgcctttggtgatggtttcacctgccgattccgaattgatagccgggggaagtgaggagcgtcgtcggtttatggatgtagtgatttcgcagtatgataaggaatatcttgaagcgctgatacggtataataaagcattggcgcagcgtaacacattgttgaagagtgagtttccggtggaggaggagctgtttcttgtatgggaggagatgatggcgcaagccggtgcaatcgtattccagaaacgtgaagcgtttatccgggagtttattcctattttccaatctttctattcctttatctcgcaggataaagaggtggtgggattatcttatgagtctcatgcgcgggatgcttctttgttggaagtgttgaagcaaagcaggaagagggataagataatgggattctctttgcgtgggattcataaagatgagttgaatatgttgttgggtgaattcccgataaagaaagaaggttcgcagggacagaacaaaacgtatctggtagcattgaaactggcgcagtttgatttcttgaagcgtaccggccggactgttcctttattattattagatgatattttcgataagttggatgcttcccgtgtagagcaaatagtgaagctggtggctggagacaatttcgggcagatatttataacggacacgaaccggggacatctcgaccgtattttacataaggtaggcagcgattataaaatatttcgtgtagaagagggcacaattcaagaaacggaggctgataatgaagcgcaatgatgccgaacaaataggaaaactgattcaacagtttcttcgtcaggagagtttggaatctccgctgaacgaacaaagactgctggatgcctggcctcaaatcttgggaccggcggcggcttataccagcaatctttatattcgtaatcagacattatatgtgcatctgacttccgcagctcttcgtcaggaattgatgatggggcgtgaggtattggtgcgcacgctgaatcagagagtcggagctaccgtaattacaaatattatttttcgttgaagaaagatattctgtctataacctttatacctagcttccggagtgtttcggttgcacggttgtaataaaaaggattttccaaatattgattgttatgggcgtctacgccgatgatagcggtgcaaccttcatgggcggctattttccagaaatccggatgaggaatggtagtaataccatgaatatcattgtactcttcatatccgatattatattccaacggtaagtttaaccgtactgccgtccggcagatatgtctgctgactagcttacaatgacgatcgaactcggggtaagaacgcataaataaatccggatgggcaaggtaggcaaatagtccgctttccattccttcaatagcactctcttcatagagttcgagcatgtctaccgaatctgtattccggccgaagtaggggaacttctcatctgtgtgaaaatggtgatttccaaagatgatatagtccagtttatattctttgatgattccttttaaccagtgtatgtattcaggaaagtattcgcattccaatcctatttttatgctgatttgatttttatatttctcttgcagcgaacggatactttccacatatcccggtaactcttcgggaagcatccggatgtcggatatataatcagtgtgatatttccacggagtgtggtcagaaaagcctaattcttgatagccgcctttgatggcacttaaaacaaattcttcgtcactccctgtcgcatgatggcagcgggtggtgtgggtgtgataattcgtcttcattgattgttatgattatatccatgcggatgtcgaatgattccgccggaacttcttctactaattgaaatgggaaacatattcctgctttataggctgatggtatgcgtggcaggagacggtcataatatccttttccccgccccaaacggttacctttagcatcgaaagctactccgggaacgacgatgaactctatggctgcatagtctgtgaatatttctccggttggttctgctataccgtagatgccgctgattgacatgttttccggtccggtgtatatccgtagttctaaatcatcgcctactactacagggagtagaatccgtttttcgctactccatttttgaataaaggcatgtgtatctacttcgtcattcagcgaatggtatagtaatacagtatttgccgccctgaaagccggatgggcttcaagggcggcaagtatattagctgattgcagctttcgcatagttgaatccgcgtgttgggtcttcagtaatgctatacgcttgcgcagttctttttttctttccatcttttttgtcctttgtcacttcttcctcttcaacggctaccggagcttttgggaaagcttctcctttttcgagtatctcaatgcctttaatgacggtagcatctgtcttgttaaaatattgaagataagcttccagtccaagcatattgtagatgatgttaccaaagaggttcttctccaaaagtttgtatgacttctgaatgaggatatttcttcttttcactcctttgctgtcggcaaaacggacaaactgttctaccaatccctgatgacgaaggtaattcagcaattcttcctctgtttcatattggctaagtttcttccggttattgtcggtgtactggaaagcgaactgggtattcactccccggctaataactgttgaaaggtaggaagtgactcccgtagtgtcttgtggtacgaatatatccggcatgatgccaccaccaccatatacggtacgtcccaaactggtattatatcgttcactttcatttagcttgatgctgtcgcgagagaagaattctccatgttcgtaacggttataaatatctaactcgtagttgcggtctttaccactttcgtatgggcgttggatacaacgtccggatggagtgtagtagcgggcgattgtcagacgaatagccgaaccatcactgaaatcgataggctgttgcacaagtcccttaccgaaagaacggcgtcctacaactgttccccggtcattatcctggatagctccagtgaagatttcactggcagaagcagaactttcgttaatcaatacgacaagtggcattttctgacaactacctgtaccgttagcaaattcttcagcacgtggatatttacggccttgagtatatacgatcagcttgccttcaggtaggaattcatttaccatgcggatggcagcttccatatatcctccggtattatcgcgcaggtcaatgatcagacctttacattttttatggttgagttgcgctaatgcattgagcaattctacatggctggtacgtccgaatttgctgactttcacgtaaccgatgtcatcgtttagcatataagctgcatcaacggtattttgaggaatgtctccacgggtaatgttgaaatgcaataagtctttttctcctgttcgtttgatacctaatttcacttgtgaacctttcgggcctttcagagtgcgcatagcccgttcgttggttactttcttaccgacaaacaaactgtcgtccacggtaacaatacggtcgcccgccatcaatcctatcttttcagaagggccaccctgaacgactgcattcacatgaatggtgtcgttctgtatagtaaactggataccgatcccgctaaagctaccttccagttccgagttgacttcttcgagattttgggctgggatataagttgaatgtggatctaattcggccagaatttgcggcatggctttttccactaaatcggtcatgtttacggtgtcgacatattgatcgtctacaatgcgtaacaatgcgtttagcttattggaggaaccgttgataatacccaaacggttgccggcaaaatgcttggcataaaatgtaccgataagaatcccgactaccacgctgactgctatgatgacaggtgtaaaacgtgaagagttttttgtactcatgtctattcctttttaaaacgttcgtcttcttatttatttggagaggaattgttatccaactcagtgtagataacttcgattcccgcccgttttaataactctattccatcttccaggcggtaatgttcggaataaactacccgtttgattcctgcctgtatgattaactttgcacattcgatgcaaggagaggcggtgacgtacatggtagcaccgtcgctactgttgtttgaacgtgctattttggtaatggcattggcttccgcatgcagaacgtatggttttgtcaggttgttttcatcttcacatacattctcgaatccggaaggtgttccattatatccgtcggagataatcattttatccttaacaattaaagctcctactttacggcgttgacaataggaattttcagcccatatactggccatacgtatataacgtttgtcaagttctaattgtttcttttcagtgtccatgttgtttactatttactgcttactacccggaaaaccatacggaaagtttgtttaccggatgccggtttgtataaaaggtataagttattactatctccttcgtaagatgtagctgcattaagcccctctataaaatttttggcgagtttgtcgtcgccataactacctgcagtggtaactgtagctttgaagctattgtttttggcgttggcattccattttccttcaaaagtactggttgcaattacagttccttttatatttccgttaataacatctccatctactgtgccatcaaatacaatattatatgtaccgtttttattaagctctttaatacttgctttctcttgttcttcattctcccaaaagccaaacatctcatgacctccatctactgtgatataatttagtttccaggtttttcctgtaaagatagcagctacatcgtccgaatcattacatcctgaaaataaaggaagcaataaaagcaatcctactatttgaaatatacttctcttcatatttaatatctaataacttaatacttatttctttatcccatttctgattagcaaagcatcaatgctcggttcctgtccgcggaaacgtttataaagtatcatcggatgttccgttcctcctttcgacagaatattattgcggaatgagtctgccacttcctgattgaatatccctttttgcttgaataatgaaaatgcgtcggcatccaatacttccgcccatttgtagctatagtatccggcggcatatccaccggcaaagatgtgggagaattgcgtactcatacaagcttcttgtactaccggcaatatttgcgcatccttccaggcttcttgttcataagctttcacatctccttcaaaaggagtgttgtgcgtataccatgccatatcaagtaaaccgaaacttatttgtcgtagacaagcatacgcaacattgaagtttgatgcatctacaaggcgttttatcaattcatccggcaatacttctcccgtctgataatggcgggcaaaggtattgaggaaatctttctctatggcgaaattttccataatttgcgagggaagctccacgaaatcccaatatacattggttccacttaaactcctgtaagtagaattggcaaacataccgtgcagactatgcccgaactcatgcaagaatgtttctacttcattgaaagtcaataaagcgggcttattctcggttggcttggtgaagttcatcacaacggatacatgagggcggctgtttttaccggtctttttatctatccattggtccttataactcgtcatccaggctccggcccgctttcccggacgcggatggaaatcggtgtataagacggctaaaaatttaccgtctttatcaaacacttcaaaggcttctacctctttatggtaaaccggaatttctgtatttttccggaaagtgattccatataacttttctgccaagccaaacacccctttcttcacttgttccagttcgaagtaagggcggagcatttcttcgttgatattgaattttttgtcctttagtttatttgaataataactccagtcccaaggcatgacaacgaaatcagctccctgttcttcgcgagccagttcttgtatctctttatattcttgttgtgcagtaggagtgtatgcttccagcagttggttgagcagcttgtataccgacttgctgttttcagccattcttttctttagcgtatattccgcataatctttgtatcccagtaactgggctattttcatgcgtgtattggctatcttttttacgatgtcgatattattgaattcgttatcgtgtgtacatttggtattataagccatatagagtttttgacgtaaatcccgattgtcagaatacgtcatgaaaggaatatagctcggagcgtgaagtgtgaatgcccatccttctttttcttcgttcttggccgtttctgcagctgcttctatgataatttcaggtagtccggcgaggctctcttttttcgttaacagcatttgataagcattcgtctctttcaggttgttttcactgaaggtaagcgtcaatttactcaattcggtagtcagacgacggtattcttcccgcgcttctccttccaaattggcaccatgacgaacaaaactgttgtatgcattttccagtaactgtttttgttcctgtgtcagttgcaaagtctctttttggttatacacttctttcacacgtgcgaataacttttcattcagtgtgatattattgctgtgttcactaagcaacggcataatcttttgagcgagttcttgcagatcgtcattcgtttctgcgctcaacatattgccgaagacggcaactactttatccagtaattcccctgattcttcgaaagcttctatcgtattgctaaaatcagccttttccggattctgtatgatagcctctatttcagcattttgcagcttgattccttcgaggatagcaggctcataatgttcagtttcaatccggtcgaacggcacggttccgtgcggcgtatggtattgcccgtagaaaggattctgggcgtttgttatattgctcatagtgcaaactagtatcaatgttattaataatctctccatagaagtacaaagctactaaaattgtcgcttattcaacggataacacgttgctttttaacaatatataaaatgaaatgtataaaaaaaccgctacggtttcccgcagcggttttctatatggttcaagcttctaattaagcgttaactgatgccatgtgagcgatcaagtcaagaactttgttagagtaaccgatttcgttgtcataccaagatacaactttaacgaaagtatcagtcaaagcgatacctgctttagcgtcgaagatagaagtacgagcgtcacctaagaagtcagaagaaactactgcatcttcagtgtaacccaggatacctttcaattcgccttcagaagcttctttcattgcagcgcagatttcagcgtaagtagccggtttagccaagttaactgtcaagtcaactacagatacgtccaaagtcggaacacgcatagacataccagtcaatttgccgttcaatgcagggattactttacctacagctttagcagcaccagtagaagaagggatgatgttgccagaagcagcacgaccacctctccagtctttcatagaaggaccgtcaactgttttctgagtagcagttgtagagtgaactgtagtcatcaaaccgtcaaggataccgaacttgtcgttcaatactttagcgataggagccaaacagttagtagtacaagaagcgttagatacaaattgagtaccttttacgtatgtcttttcgtttacaccgcaaacgaacatcggagtgtcatctttagaaggagctgacattacaacatattttgcaccagcttcgatgtgagcctgagctttgtctttgctcaagaacaaacctgtagattcaacaacgtattctgcacctacttcattccatttcaaatcagccggatttctttcagctgtgatacggatagcttgaccgttaacgatcagtttgctgttttcaacatctgcttcgatagtaccgttgaactgtccgtgcattgtgtcatacttcagcatgtaagccaagtaatcaaccgggcaaaggtcattgatacctacgatttgaatatcgtttctctccattgcagcgcggaaaacgaaacgtccgatacgtccgaatccattaatacctactttaatcattttgtttaaacttttaagggttttataatatttgttcaaatatctctcgacctgcgcacttgttttattttcaaatgcggtgcaaaattacaaaaatgtttttatattcgcatattaaattcacattaaatattgaaaaaagatgggaaagagcacatttttacaggactttaaggcgtttgctatgaaaggtaacgtcatagatatggctgtcggtgtagttattggtggtgcgtttggaaaaatcgtatcatcattggttgctaatgttattatgcctccgattggtttactggttggcggtgtgaactttacggatttgaaatgggtgatgaaagcggcggagatcggtgctgacggtaaggagatagctccggctgtgacattggattatggtcagtttctgcaagccacctttgattttctgattattgcttttgctatattcttatttatacggttgattacgaaactgacaactaaaaaacaggcagaagtgccagctactcctccggctcctcctgcaccaacgaaggaagaagtcttgttgacggagatacgcgatttgctgaaagaaaagaatagttgattctaattaaaataaaggagattccaagtataaacttgtgaatctcctttatttttctcttcattattaatatagattgcgtacttttttctacttttgcaactcaatttattcaaaatccaaccattgatatgcaggaaaaaataataattcttgatttcggttcgcagacaacacagcttataggccgtcgtgtacgtgaattggatacgtattgtgaaattgttccttataacaaatttcctaaagaagaccctactattaaaggagtcattctctccggaagtcctttctcggtttacgataaagatgctttcaaagtagatttgagtgaaattcgtggtaaatatccgatattgggtatttgttatggtgcacaatttatgtcatacaccaatggcggaaaagtggaaccagccggaacacgcgaatatggacgtgctcacttgacttctttctgcaaagataatgtgctatttaaaggtgtacgtgatggatcgcaggtatggatgagtcatggagatacgattactgctattcctgataatttcaagaaaatagcttcaacagataaagtcgagattgctgcttatcaggtagaaggtgagcaagtgtggggtgttcaattccatccggaagtattccatagtgaagacggaactcaaatcctgaagaactttgtggtagatgtttgcggttgcaaacaagactggtcgccggcttctttcattgaaagtacggttgccgagctgaaagcgcagttgggggatgataaagtcgttctcggtttgagtggcggagttgattcttcagttgcagcagtgttgttaaacaaggctatcggtaagaacttgacttgtatctttgtagatcacggtatgctacgtaagaatgagttcaagaatgtgatgaaggattacgagtgtctcggtctgaatgtgattggtgttgatgccagcgcaaagttcttcgcagaactggctggtgtggctgaaccggaaagtaagcgtaagattataggtaagggcttcatcgatgtatttgatgtggaggctcacaagataaaagacgtgaaatggctggcgcagggtaccatttatccggattgtattgagtcattgtctattacgggtacagtgataaagagccatcataatgtaggcggtcttcctgaaaagatgaatctgaagttgtgtgaaccgcttcgtttgttatttaaggatgaagtgcgccgggtaggtcgtgagctgggtatgccggagcatctgattactcgtcatccgttcccgggaccgggattggcagtgcgtattttgggagatattactcctgaaaaagtacgtattctgcaggatgctgacgatatcttcatccagggattgcgtgactggggattgtatgataaagtatggcaggcaggagttatcttgttgccggtacagtctgtgggcgtaatgggagatgaacgtacttatgaaagagcggttgctttgcgtgctgtgacatctacagatgctatgacagccgactgggcacatttaccttatgaatttatgggtaaggtatcgaatgatattattaataaggtgaaaggagtgaaccgtgtaacctatgatatcagttccaagccgccagcaaccattgaatgggaataataacattatccatcataaaagtagcctcaacaggaatttccgttgaggctatttttatgatggatagtttttttttgattgctcagtccgtatctactcgcttaccagcttttgtgcgtccggaataagaatctctttccggcgtaactctaataatcctttgtcttgtagctcgttgagtgctttcgatgtattcaaccgggtatcatctaagtagcgggcaaggtcgtccatttttactttgaatatcttttctccctgcgccttttcacaatgtaacaggaaaaagcgaatgattttctctcttaaatcctgtgtcggctcttcccataaacgtgagtaaagattttgtgcccggttacttacgatgttcatatagttcagccggaatatttcatatttgaacaggtcgctaagtacgaatgctttgctgatactgacggtatgcgcttccgtatgtgccacataagcagaagtgtaatgggtattcatgccaaacaacgactgtggttccagcagataaggtgcttccatctgttcgatgacggtgtatatattttctttggaacttgtgacgatagaaacctctccttttaataggaagcagagttgtttacacggactaccactctctatgatagtttctcccactttatgcttgataaagtgtagcttgaccttatccagaatacttgtgaaatcttcatgacaaagaccttgaaataaaggcaattggagcaaagtgtcgaacattgtttccatatgttgtaatctcttgttaatcgtacaaatttactcataatacaatactgctgtcaacatctgaccgttctttttgttttttttattgtttgaatgcataaaaatagagtatatttgcagaaaaaaaggagggaattatgttcgcaggcttcaattggcagcagatgattagtgcgtttatcgtactttttgccgtgatagatattatcggctctatacctattataattaacctgaaagaaaaagggaaagatgtgaatgcaatgaaagctactgtcatctcttttgctttgctgatcggatttttctatgcgggagatatgatgctgaaactctttcatgtagatattgaatcgtttgcagtagccggtgcatttgtcattttccttatgtctttggagatgattctggatattgagattttcaagaaccagggtcctatcaaagaagcaactttggtgccgcttgtctttcctctgttggcaggtgccggagctttcaccactttgctttctcttcgggcagaatatgccagtgttaatatcattatagctttagtcttgaatatgatctgggtttactttgtagtgagtatgaccggtcgtgtagaacgtttcctgggaaaaggaggcatctatattattcgtaaattctttggtatcatcttattagctatttctgtgaggttgtttacagccaatataacgttattgattgaggcgttgcatcggtcttgattttcttattaaattgaaagctattgtatcggatgtgccatcgtgttggcacaactgtgacatgtctttgtcgcaatcgtgccactttgatgtcacaagtgtgccaatgtggtggcacgagttggcatttataacgtttcttcttcttctgctgctgttgtttcttcttctgtattttcttcctcttccatttcgtccgcaaaaggttccgggcgttgcggtccgtgatttacgaaaacgaaagcacagagtgttcccataattcctccgctaagatgtccttcccacgacatattggtgggggagaaataaggaaacatatgccatataatccctccatataaaaaggtaacgagtagagagatggcaatgagtggaacatatttgcggagaataccactgaaaaagagaaagaaggtaagtccgtaaattaatccgctggcgccaatgtgccatcccggttttccaatcaggaaagtaagtagtccgcctccgatccagattaggataaaaatcttacctgctatcccccggtaaaagtaaaaaagacaccatgacaagaaaaataaaggaattgtatttgccagtaaatgactaaatccgctgtgtatcaatgggtgagttaaaatacctaccagcccccgtttctccataggatatacccccaagcgagagaagttccagtccattccgacttccataatcttgagtatatagagaataaaaataagaaacaaaggctttgctgcagccagcatgatacgctgaatatcttgcttcatgacattcttttctttagatattttacgcaatactacgaatatttgcacaaaatctgaaaataaaaagcctttttatttttgtttttatctataatttgtacatttgggcgttatacccgttgtatatgatgctacaaccaatatatgcggtatgtaacaataaatagatatacgatataatgaccaataattaacctttaataatgcacaactatgagttatttacgatttgacaagaccctcatgacgaatctggaagagtctcttcaaagagaaatcctccggacgaacaaagcaggagcttatcattgtacgacgattgttgattgtaacacacgcaaatatcacggcctgttggtaattccagttcccaatatcgacgatgaaaatcatgtgctgctatcttctcttgatgaaacggtaattcaacacggtgcggagtttaacttgggattgcacaaatatcagggaaacaactttagtcctaacggacacaagtatatccgcgagtttgattgtgagcatatcccggcaacaacttaccgtgtcggaggtgttatcctccgcaaagaaaaaatctttgtacatcatgaaaatagaatcctgattcgttatactttgctggatgcgcattcggctacgactttgcgcttccgcccgttcctcgctttcaggagtgtacgtgagtacacacatgaaaatgcgcaggcaagccgcgagtatcaacttgtggaaaatggtattaaaacctgtatgtatcccggatatccggaactatatatgcagttgaataaaaagtgtgagtttcatttcatgcctgactggtatcgggggattgaatacccgaaagaacaagagcgtgggtatgacttcaatgaagacctttatgttcccggttattttgaggtggatataaagaaaggggagagcatcgtattctctgccggaacttcagaagtgactccccgtagattgaaacaaacatttgaggctgaagtgcttgatcgtacccctcgtgatagcttttaccattgtctgaagaattccgctcatcagttccataaccagcaggaagacgaacattatattcttgccggttatccgtggtttaaatgtcgtgcacgtgatatgttcattgccctgccgggactgacgcttgcactcgatgaggtcgaccagtttgaggatgtgatgaaaacggcggaaaaggcgattcgcaattttataaatgaagaaccagtaggctacaagatttatgaaatggagcatcctgacgttttgctttgggctgtctgggctttgcagcaatatgcaaaagaaacttcccgtgagcaatgtcgtcagaaatacggagaactcctgaaagatataatggagtttattcgtcagcggaaacatgagaatcttttcttgcatgataatggattactttttgccaacggtacggataaggcgattacatggatgaattctacagtgaacggacatccggtgattcctcgtacggggtatattgttgaatttaatgcgttgtggtataatgcgttgcgttttatagctgatttggtgcgcgaaggaggagacgtatacttggcggatgaactcgatgcgcaggcagaagtaaccggaaagtcttttgtcgaggtattccgtaacgaatatggttatctgcttgattatgtagacggtaatatgatggattggagtgtacgtcctaacatgatatttaccgtagcgtttgattattctcctttggatcgtgcacaaaagaaacaggtgcttgatattgtgaccaaagagctgctcactccgaaaggaattcgttcgttgagtccgaagagtggcggatataatccgaactatgtaggtccgcagatacaacgcgattatgcttatcatcagggaacggcctggccttggttgatgggattctatctggaagcttatcttcgaatttataagatgagcggattgtcattcgttgaacgccaactgattagttatgatgacgaaatgacaagccactgtgttggttccattcccgagctattcgatgggaacccgcctttcaaaggacgcggcgcagtatcgtttgcgatgaatgtagcagaaatactgcgtgtcttaaagctattgtctaagtattattaaaaaaggaggaacgaagatgaaagttttaatgtttggatgggaattccctcccaaaatatatggtggtcttgcggttgcttcttatggaataactaaaggattgagtctgcaaggtgatatggagacgattttctgtatgcctaaaccgagcggtgaagaagaaaagttcttgaaaataatcggtatgaatcaagtacccatcgtgtggcgtgatgtcaactacgactacttgaagtcccgcttgttggaaatgacaccagaggagtattattctttccgtgatcacatctatgccgatttttcttatatgcatgtgaatgatttgggatgtatggagtttgcaggtggttatcccgggaacttacacgaagaaattaacaatttctcgatcattgccggagtagtggctcgtcagcaggagtttgatattattcatgctcatgactggctgacttaccctgccggcgtacatgccaagatggtaagtggaaagccgctttgtatccatgtgcatgctactgattttgaccgttctcgtggcaaagtcaatcctactgtttattcgattgagaagaatggtatggatcatgctgattgtatcatgtgcgtatccgagttgactcgccgcactgttattaacgagtatcatcaggaccccagaaaagtatttgcgatgcataatgctgtttatccattgtcgcaggagctgttggacattccacgtcccgatcattcaaaagaaaaggtggtcactttcctcggacgtattacgatgcagaaaggaccggaatattttgtagaagctgctgcacttgtgttgcgtcgtactcgtaatattcgtttcgtcatggctggctcgggcgatatgttgaatgccatgattaacctggtggctgaacgcggtattgctgaccggttccatttcccgggttttatgaaaggtaagcaggtatatgaggtttataagaacagtgatgtatttgtcatgccatctgtctctgaacctttcggtattgctccattggaggctatgcagtgtggaacaccttccattatttctaagcagtcggggtgtggcgagattcttgataaggtgataaaaactgactactgggatattcatgcaatggctgacgctatccattctctttgtactaatccgtctcttttcgaatacctcaaggaagagggaaagaaggaagtagatgggattacttgggagaaagtcggcttgagaatccgtgctctctatgaggctgtgttaagaaactatggtaaataacaaaacaataaataaaaatgagaactatctgtctttattttgaaatacatcaaattatccatttgaaacgttatcgtttcttcgatattggtaatgaccattattattacgatgactatgcgaatgaaacgggtatgaatgaggttgctgaacgttcgtatattcctgctctcaatgctttaattgagatggtgaaaaactcgggtggtgcttttaaagtagcgctttctatctcgggggtagctttggaacaattggaaattcatgctccggcagtcattgatttattgcaccagttgaatgaaacaggatgttgtgagtttttgtgtgaaccttattcacatggtttgtcttcacttgccaacgaggattgcttccgcgaagaagtgcttcgtcaacgtgataagatgaaacagatgtttggtaaagaaccgaaagtattccgcaactctagtctgatttattctgatgaaattggtggcttggtagcttctatgggcttcaaggggatgttgacggaaggggctaaacatatcttgggatggaagagtccgcattatgtttatcactgtaatcaagctcccagtcttaagcttttgttgagggatttcaaactttctgacgacatcagcttgcgcttctccaattcggattgggctgaatatcctttgtttgccgataaatatattaattggattgatgtattgccgcaagaggaacaagtgattaatatcttcatggaattgagctcgcttggtatggctcaaccattgtcttctaatattcttgaattcttgaaagcgttgccggaatgtgcaaaggctaagggaatcactttctctacaccgacagaaattgtaacgaaactgaaatcggtgtcacagcttgatgtcgcatatccgatgtcatgggttgatgaggaaagagatactagttgttggctgggtaatgttatgcaacgcgaggctttcaataaattgtatagtgtagctgaacgtgttcatttgtgtgacgaccgccgtatcaagcaggattgggattatttgcaagctagcaataacttccgtttcatgacgacgaagaataatggtatgtggttgaatcgcggaatctatgattctccttatgatgctttcaccaactatatgaatattctaggtgactttatcaaacgggtagatgcactatatcctgctgatgtagacagcgaagaattaaattctttgttgactacaattaagaaccagggggatgagattaccgagttagaaaaagaagtggctaaatggcaggcaaaagcagaagcggcaaagaaaacgacagtcaaaaaggctgctgatgctaaagaaccggtaataaaagaaaaagctgttgctaaatcaaaacctgctgcaaagaaagctgaagttaagaaagcagctgcggaaccgaagaagactacaggtaaagctaaaaaggttgctgctaaataaggagtataagattgttatatatggaaccgtgggtgagataaaaggcactcacggttttttatgatagagattttaagggatttcaatgaatgtctttttttgtataatacaaagagtgaaatttaccttggcagttttcatctgaatatatatctataaaacaatagcacagattactctaatgtaacctgtgctattattttatagattatcttacttgtcttttatttcgattttgttccgaagtttgtagagacaacttcaagtttgagtaaatactctggatatgaagggttgccttgagcatcttgtatacttcctttgctacctccttttaaacgtgcataaccaggtttcaggtcatgttgtatgctaataacattgctcgaagaaccataatagctattacttgaagaagaatctgtggttacaagtactggaataagtatgaatttgttccaatcactatatttttcccattcttcaatattatgaacctctttagattctgttttgccttcggagttagttatttggagagttatcgtaccattcttgagtttcttttctgcttcttctctttctccatctcctaaacaattatttatcatttgagtgatattgttgaatgtatattgggtaaagctagttgtagtagaagtaaatagagatgaagttataccatcgctaagttgattacctttgaagaaactatctttatactttttacgtattaataaaacgttattaggagtagacatgccaaacttcttatcactggtttcattatagataggaattcctaattttaccgcattcaaagtgtctccttgaagcttttctgctatttgactaacagggagagttaactgagtaaagattccagctggactttttaagtaagtccattcagatttattgatgcaattttgaatggctgctttatcattctctaactggtttgcttgaataacttcacgagtggtagcgaacgtacgatatccatagtaagtagagtctttatatactccattttcagctactttcttttgcaatttaacaccagtaattgtatcaacagcatagcatttatatactacgttcatctgagcttgatttatataaagtaccgtaccatcaccataatcactcttcacataaattcccttaaaaatcttcctaaactctttattgtcaagattgacacctaactcattggctttttttataatctctttaccaatttccttggcagcttcgtctctgaaagaaacatgaacactagggacatatgtactaagattacgaatagagtcttttactgaaagatcgactgctgtataagctttcgtgcctaataagctattaggatctgcgtgatcgtagtagttttccggattaatatttgtatagtaggcatgctcagtatctaagttctcgctcaattcatagacactcaaacgacaagctgttaatgaatctccaaagtaactgctataccataaataaagttcgatagtgtggatgttaccaatgattttattgttgtcatcacgtatgaatgtgacatctttattatcttcattatcatcccctaccattacgcgggtagctttcttcttttcgtccaaagcagtaccatcatatactccagggaatgtcattcctgacggacagttgagttctgccaagaagcctgcctgataagttccaaatatttcatcagtgaacttacctacataccccacattagtcattgcataaatctcaccggcatgaacggattcggtagttacatcaaatgtagatagctttccattgatattttggtcgcttcccggaaacattcccaatcccagtccggcagtgttgtcatcacaaccccaaaaggtgattgccagtaaagctattaaggcgtattttgctttcatgatcgtcgtatcttgattttttattcttcttcgtttgcagtggcttcccatacttgatcgtagaactcgttgcaggcatctgcatagttttccgggttctggtagtcaagtaccaatttgccagattggcgggcatattcaataatagactcgtctaccttttcactgttttgtattactccgtccgaatagtcaacagcgagtttgcaaagagcggcgtagtctaccggttccttcaaatcacctaaatctttcttagtaatacctttcagcatcagttttgttgcgaaatcgtcgctaagtgtactcttgaaatcatcttcataaacagagaataccactttagcgtcgcggaaagaaggttcgtctttataggctttcttaatataaagaggagctaaagctgtcatccagccatgacagtgaatgacatcaggacaccagcgaagctttttcactgtttccaatacaccgcgtgcatagaaaacggcacggctatcgttatcatcatattctataccattttcatccgttgtctgcatacgattctggaaataatcgtcgttatcgatgaaatatacctgcatgcgtgcggattggatagaagcaacttttataatcaaggggtggtcagtatcgtcgataatcaggttcataccagagaggcggatcacttcgtgcagttgatttctgcgctcattgatatttccccatttgggcataaaggttctgatttcacggcctttttcttgtattgcctgtggaaggtttctacctatattggccatttcggattctgaaacgtaaggtgtaatctcttgagtaataaataaaactttattcgcctttgtcataataacaatagttcactataatattctgcaaagatacgaaaaaaaagacacattaaataagatattctttctttatgtggcaaatattagtttattttgcagagtttttgcaaacgagtaaaacataaaccaattgacgaaaatgaaagtagtgcacactatcaaggacttacaggcagaattgactgccctaagagcccaaggtaaaaaggtgggactggttcctacaatgggtgctttacatgcgggacatgcatctctggtaaagcgcagcgtaagtgagaatggtgtaactgttgtgagtgtttttgtgaatcccacacagtttaacgataaaaatgacttggagaaatatccgcgtacattggatgcagattgccgtttgttggaagaatgcggggcggatttcgctttttctccttcagttagcgaaatgtatccggaaccggatacccgtcaatttagctatgcaccattggatacggtgatggaaggagctttccgtccgggacattttaacggtgtttgccaaattgtcagcaagctatttgatgctgtacagccggatcgtgcatatttcggagagaaagacttccagcagttagcgattattcgtgagatggttcgacaattgaaatataaccttgaaattgtaggttgttcaattgtacgtgaggaagacggactggcattgagtagccggaacaaacgtttatctgcagaagaacgtgaaaatgctttaaatatttctcgcaccttatttaaaagtcgtaactttgcagccactcatacagtgagcgagacgcaaaagatggttgaagatgcgattgaagccgctccgggtttgcgtatggagtattttgagatcgtagacggaaacacattgcagaaaattagcaattgggaagatacttcctatgcagtaggatgcatcacagtgttctgtggagaggtccggctgatcgataacattaaatataaagaataactaaaaagacgaaaccttatgatgattgaagtgttgaagtcgaaaattcattgtgcacgtgtcacggaggcaaatctgaactacatgggtagtatcacgattgatgaagacctgctggatgctgcaaacatgattccgggagagaaagtgtatatcgctgataataacaacggtgaacgctttgaaacctacattatcaaaggtgaacgcggttcgggcaaaatttgtctgaatggtgctgctgcccgcaaggtgcaacccgatgatattgtgataatcatgtcctatgcattgatggattttgaggaagccaagtcgtttaaaccggctgtaattttccctgatcctgcgacgaacaaagtagtaaagtagaaagtatctttgatatttgaaataagaaaagccccgtttacattttgtaaacggggcttttcttattctactttttatgctgggggtgatcgatgttctacccacgtgtgagttggttttagcccacctctcgataaacttccgcccacgtgtcagatgtagttatcccacgtgttagggaagtttagcccgggtgttaataagcggcagttagttgccggcgtttgttttcagttgctcattcatagcagcggcagctttacggccatcacccatcgccagaattacggtagctccaccgcgaacgatgtcaccacctgcgtaaatcattgggatagaagattccatgttgtcatttactgcgatagttccttttcgtcctaattccagtcctttgatagagcttggaacaatcgggttgggagataccccaacgctgacaatggccaggtctatatcgattgtttctgttgctcccgggatggctacaggactacgacgtccggaagcatctggttcgcctaattccatcttttgcagaataacctgttttacgcaaccttgttcatcagcaatatattcgataggattatgcagagtgaggaattcaactccttcttctttggcgtgttttacttcttcgatacgtgcaggcatttcttcttccgaacgacgatagataataatagcacgttcagcgccaagacgttttgccgtacggacagagtccatagctgtgttaccgccgccgattactgccacattcttaccgaaagctaccggagtgtccgaatcttcgctggcggcatccatcaaattgacacgggtgaggtattcatttgaagacatgatattgatagagttctctcccgggatattcataaagtttggcagtccggcaccggaagccacgaatattcctttgaaaccttccgctttcaagtcttctacaccgatagtctttcctacaatacagtctttgatgaagttaacgcccatcttaccgagattgtcgatttctacgtctacaatcttgtttggcaaacggaattcggggataccgtatttcaatacaccgccaatttcatgcaacgcttcgaatacagttacatcatatccatatttagccatatctccggcaaatgccaatcctgcaggtcctgaaccgataacagctattttgatgccgtttttctctgcaatgacaggtacggagatttgtccgctttcacgttcataatcagcagcaaaacgttccaaataaccgatagctaccggcttttcattcattttcagatgaatacattttgattcgcactgtttttcttgtgggcacacacgaccgcaaactgcagggagcgcacttgtttctttcaatgttttagcagcttcgaggaattcgccgcgttcgatattcttaatgaagcggggaatatcaatgcctaccggacaaccttccatacatcccggattagcacagtcgagacagcgtttcgcttctgtaacagcctgttccgctgttaatccttgattaacttcctctttacggctgtgtgaacggtattcagcatcgagttcattcatctctacacgaggaatagccgtacgttcttttggcttcatggatttacgtaattcctgtctccaagcagcattacgacttttttcatctatttctttggttgcttcacattccgattccagcttatgcatttcttcgcgttcgatattcttgaacgcacccatacgtttcagcatttcgtcgaaattcacttggtgaccgtcgaattccggaccatctacacaaacgaatttagtctttcctcctacagtgatacggcaagcaccgcacatacctgttccgtccaccatgatcgtatttagcgaaacatctgtcggaatttcatattttttagtcagcaagcaaacgaatttcatcatgatggcagggccaatagcgaaacatttgtctactttctcacgtttgataacttcttctacaccttctgtcaccagacctttccggccgtaagaaccgtcatccgtcatgataattacttcgtcagagctttcacgcatttctttttccaagatgataagatctttattgcgtccagccaatacagtgataacacggttaccggcagccttcaaagcctgtacgataggaagcatcggagccacacctacaccaccaccagcgcagattactgttccgaatttttctatatgggtagcttgtccgagtgggcctactacgtcagtgatataatcgccttcattcagctcgcagagacgggtagaagaaagcccgacttcctgcactaccagagtaatggtgccctttttcaggtcggaacctgcgatagtcaatggcatacgttctcctttttcgcctacacgtacgatgacgaagtgtccggccttacgagatttagcaattaaaggagcttcaatttcaaatttgaatactttctcagaaaagcgttccttgctaatgattttgttcattatctaattaatttgttgtttttattacgtaactgctatcagaatgatataaattttggcaaagatacagcttatttgcgaaatataaaagaaaagccactcttttgatgagtggctctttatataagggtgcttttattagtctgtcagatcaagtcttagtctatcatgtcgaagccgcagtacggaaccaatgctttcggaattctaatgccttccggagtctggttgttttcgagtagggcagcaacgatacgtggcagtgctaatgctgaaccgttcagtgtgtggcagagttcggttttcttttctgcattacggtaacggcatttcagacgattggcctgataggtatcgaaattggatacggaacttacttccaaccagcgtttctgtgcctctgaatatacttcgaagtcgaaacaaagggcagcagtgaaactcatatcaccaccacagaggcggaggatacgatatggaagttccagtttttgcaacagaccttctacgtggtcgagcatttcctgatgagattgtttggagtgttccggtttgtcaatgcgaaccaattctactttggagaattcgtgcagacgattcagtccgcgcacatctttaccataggaaccagcttcacgacggaaacattgtgtataggcgcaattcatgattggcaactgtttttcttccaaaattacatcacggtagatgttggttacaggtacttctgctgtcgggatcagatataaatcatctacttcgcaatgatacatttgtccttctttgtcaggaagctgtcctgtgccatagccggaagcagcgttaactactgtcggtggcatgatttcagtatatccggatttgcgtgcttcgtccaggaagaagttgataagagcgcgttgaagttgtgcgcctttacctttatatacggggaaacctgcacctgtgatttttacacccaggtcgaagtctattaaatcatatttcttagccagttcccagtgggggagtgcatctttaggaagttcagtttccatacctcccattttttccactacgttatcttcagcgcctacaccttcgggtacactgtcgtaaggaatgttggggatggtataaagtacattctgcatatctgttgcagcctgtgtcatagcggcgtctagttctttgttaccttcttttagttcggcaacgcgggcacgtgcagtttcagcttcctctttcttgccttctttcatcagttgaccgatggtgcgtgaaagcgagttaacctctgccagattcttatctaattcattttgtgtgctacgtctcttgtcgttaagagcgatcacttggtcgatcgtttcctttgcatttttgaaatgcttcttttccagtccgcggagtaccgcctctgtgttttctgtaatttgtttaatggtaagcatatctatactttttatgaactttcttatttaaggctacaaagataaagaaaaaacgaataatcaagcaaatatatgtgttatatataatatatatgatgtgtctatgatatatataatacatgtattgagctgtataataaacatatatgcagtgaatgatacatacatgtctcttttagagtgatatataaaactctggttgttaaaaagaaaggagatgtaatccaatggattacatctccttctcttaaatattttcagttgtgcaattatgcctcagtagcaggaacaacagaaacatatcttctgtcttctttgccaactttgaagctaactgtaccatctactaaagcgaaaagagtgtggtctttacccattccgatgttttcacccgggtggaattcagtacctctttgacgaacgatgatgttacctgctttgcaagcttcgccaccaaatatcttaacgcctaatcttttactttgtgattcgcggccgttcttagaactaccgacacctttcttatgtgccatttcttcttactttttaattgattaagctactacttctgtaattgttaattcagtgaactgttgacggtgaccgttcagttttctgtgtccttttcttcttttcttgtggaaaacaagaactttgtcgcctttaaccaagtttgaaacaacctggcaaacaactttagcgccttctacggtaggagcacctactgttacgtttccgtctttgtctaccaaaagaactttttcaaattctactgttgaaccgttttctgcaccttcgatgtggtgaacgaacaacttttgaccagcttctgctttaaattgctgaccgttaatctctacaattgcgtacatcttatatataaatgtataagttagctccggcgggtggtctttaatcacttaaagaactctttatcgaacccgttgcggaataatcgggcacaaaagtactatttttattcgttcccgacaaatatttcttttattttttataggagataaaatgattacggcaaataaatgagcattttagctctcattgtagcctattggactaattctcctaaattctgcataatgattttgtgtggataaacacgaagttcctctgccgttgtcattccgttcagcacacctgcaaaatcgactcctgcattctgcgctgtttcggcatctacggtgctatctccaatatacaatgtctcttcggggctacttcccagatgttctaatgcaaatttaactccttccggcgaaggtttcggtgcttttacatcttctcctcccactactatatcaagaaaatccttaggcagatattcttccagataactcaatatccggaaacgatacttggtagagataattccgacgcgggcaccccgtttcttcaattctttcagcgtagacaatgtgtcgggaaaaagacgggtatttacattcatgtgtacatcagcttccagtctgtactcctgccggaaggcctccagctgtgccgggtcggtaattccggtaaggatactgaatgattcttccaatgttttgccgattgtacgcttgatagcttcatcagtaacggttaaatactgatgccgggtaagcacaattctgaaacacttaacgataccacgcgacgaatcggctagtgtgtagtcgaaatcgaataaataggttttgtagttcattggggaaaacttttccgcaaaagtactaaatacttttcttatttcacagcttctaccgtgtatccttgtctttttagtaagtttaataatcctttttctccggggaggtgcagggcgcctactgcaacaaaagtcggggcagccttcatgattgccggtagtttttcagcccatgctttattacggttgtaaatcatagcatcttcttcgccgggaagtgcgtcacattgatcgcctttacgctcttcgctgattttaagcatggtgttcagatcttggttcatgtaggcgtttgtgagcttcttcaggttttctacttcagtctctatatggttaagagtgcacattaatagttgtgcttgccgttgtagtgaactgccattgaaaagcaggttgaattggaattctgcagtttccagtccgtccaccttttttccgttttggatggcttggctctgaaagaatgtgtcgagttgctcttgcgggttgaatttccctatatgttttacgtaagccattaccactacattatttaataagaaggcaggttttagcttcggagccatatttaaatctaccatcaggttttctttgcagaatttattaacagtctcaaagtctttcggagaaaggagagagttcagcgtggtatcactttcaatcatcattgccttttgcatcttttccatggtggcaggcgattgcatttccgacattttcatctctccatatacttgttgagtttcattcatagcctttttaagtccggcaatgctatccatgatgctgaacggtgccagatggtgagtgcctatgatataggaaggttggttcagtccgttgccggacactttccataaaagctgtgcattggcgctgaatgccacgcaaataaatagaactgctccgatgaatgatttcataattttatatcattagaagttgataattaacgtatcctgccgccgcttatccagtgtttggtataatagttctcgttcaagttgctgacgatcactcctttactggtgctggaatgaataaacttaccgtttttgaggtaaatgcctacatgagctactttattttttgaacgactgctggtgaagaataccaagtctccttcccggagattccgtttggcgactttattactttctttttttagatcttccgtgttacgcggcacttgggtgcggtataccttacggtacacttgataaactaatcccgaacagtcggctcctcgtttcgaatcacctccaccacgatagggaacccctatccagtcggctgcttccagatagagcttatggttatcctccatattaatatctacccccaacaatatagaagctcgcgccaatgcttgataatccagccggggcgcggaagtgcggcaggaactaaggctggcaaccagtcctaataaaaggatgaattgcaggaagtatcttttctttctatcaggtttctttatactagacttatgggtatcagacttttctgttatatatctcatcataattagtttatgcaataattttggtaaggatgaatacttaccattcattattttatcattccctatttaccgtttactcttcttctacattaaaataatcctccagttctttctctgcggagttgtcctcgttgataatatcccggatgatgacaccgtgttccaataaagcgatcctcggacatacatctacggtatgattgaggttgtgactggatataataaccgtagcttgatgctcctcattatatttcttgagcagatgtttgatgatagactgagaacttggatcgaggaagttgaacggttcgtccagtatcagtaattgcgggtaatgaagcatggcagaaataattccgatcttttgcttattacctgcggagtagttgcggattagcttcttgtgcccgatcacttctccactcataaaacgttcgaaaggaatcagacgttcgtccacttcttctttctttagtccgtacatctttccgatgaaatagaaatattcttccggagtgagataatcaatcagaaaaccatcgtcaatgaaagcaccggtaatgcttttccagtcttcgctttggctgacatcaatatcattaataatcaccttaccatcatctgcttttagcagatccagcatgattcggaagagagttgttttaccggcaccattgtttcccaccaatccgagcatatcgccttgattgatttcgtagtgttctatgtctacggcaatcttctcaccgaaattctttttaagtttgtcaatgataatcatgatcttcaatgtttatatggttaatgattcatgagcgtttattggcggctgtctctgaagccttccatgttttcgtatcgccgtttcatgaaacgatgatatacatttttaatccataaaggagaagtcagggtaaatccgagaccgacaactaacagaattatgtaagtgattgtttcacctaaaaatgcatttaatagactgtataagatgagaggcacaccgaaagcagcgaaattaaccaccatctgtatagcgctattcgtttgccggcttgccactttctcgtttaagggtaccgtctgtttgttgtagacagccagttggaaaaaacagaaataaataaagccgatggtatagaaaaaccaggcaaaggcgcccagtaaagtgagtttattcatgatgatggcgggaatcatgagtatgaaaggtatgatttcgccaatgctgtatgtgtaatatttggctttcagcagactcataattgattctttacgagacatcaggccatcaatgtaattaccttcgaatgacataatctgtgaaaggataatcattccgaatacggcaaagttgtatacacaaatgaaagaagtcatgaaattgccgtcgtaaacactggaaaagctaagtgcaacggagaaagctaccactacaatcgcgatattgcgcaatgcacctttgcagcggcggttgcgtaaaagcattttcagttccagcctcatatattcgccaacttccccgtagcgttcgaagaatttatattcggagacatgtttaatctggctatcttctacttttgccagctctgcatagataagtccggacatgatcttgcggttaatcagccataaaatggcaatcacaagtatggtgccgagaaaatagagaatgttgccctgtatatatccgtctcccagatccatgaagaaatagaagagaggactatcttcgggaatgaaaagaaggcagcctattccaccgtagaaagcgataggtaatagaatccaccaaatatgttcgttgataagagtgcggcaaagcaagtaccagtaattattggcaataatcaatagcaagataccgataagataggtgatgacaccggggataccgaaaaacttggtaatagtgatgaaggaaaaagggacaaacagaaacaaccagaacaggttgaacaggcttagtcccgagcggattagtaagaagtcgatgacacgaactcgtttaaccggcagcaggaggtaaggttttacctcctgcgtcggtgttttttgaaacggaacacgcaacagaaagtctagtgccaggataaagatcagaaccactgcgttcatcacatgatatggttcccggttgggaaccatatcagaaaatccgaacgcgaacgtcgtaccgaagaatatcaggtaaccggcccagaatgcgcccatgacataaccgagtattttagcaactttgttcttttcatacatcggatgccgtttggcggcaagccttccatgtttgcgtaattcgttgaatatcatcattcagtagatatactagagaatttttatttgttttcttccggcacggtcatgatgacttgaatttcgttgttctgtttcagcaatttggcgaggaagtcttgcacttctttcgctgtgatgctgttgaccaacttttcatagtcttttgtattatccacacccgtgtagaggtattcgtccatattattaagccagtagccgttttctttctgggcgtctttatacttcttcagcatatattctttgatcttctgcatgtgttcggcagacggaccttcttttgccattttgtgaagttgttctacaacaacagcagacaatttatctttcttggcagggtcagtttggaatacaatctgaagaacaagttcctctttcgggtatttaccaagacttccgttacagcttacaccgtatgtacctccttctttttcacggatttcagcagtgtaaaccaaatccagagcctgatctaagaagctgagcaggacattgttgcgcaagtcatatttgcaagtgccgctataaaggaacatgatggtagccatcggagtttcctgtgcctttgcaaatacatttttgatctctcccttgcggatatccatcttgttatctttgaaagtctctttacggttgatagatggcagacctcccagatatttagcgattaacggtttcattgtagccaagtctacgtttcctaccaggaagaaagtgaagtcacttgcatctttgtagcggtctttgtacatttcaagaatacggtcatagtcgatctggtctaccatgttttctttcattctgatagcacgtggatggtggccgtatagtacgcttgtaatagtgtcgctgaaagcagtcatcgggttagcgtccgcattttgaagttcagctttcagacggttcttgtaagattcgaatgcttcattatccttacgcggagatgtgaaagtcagataagtaagctgcatcattgtctcaaagtctttcggagcacagctaccggaaactgtttccgtagtgttgccgatacccgcacctacgtttgcacgtttgccggctaaagctttacccagatccactttgctgaaattaccgattccacctaccagagctactccgtttaattgagagatattgataatttcttcgttcgggaatacgctggtaccaccgaggcttacacctttcattacaatctggtcagccttgaaatcagttggcttcacatatacggttacgccgttggaaagtaccaacttagtcgtaccatagatttcaccagctttttcagaaacaatcttgccacctttaatatcttcagagattagcggttcgttagaaactttatcttcataaggtttcagatcgaatgacttcatttgtttcaataaagcagcaatttcttctttagtagggtattttgctccttctttttccggaccggccagcaaaaccacctgattgttgtcagtgattagttgttgcatcacctgattgacagcttctacagggatattcggagccagtttgtttaccagtgtatattcaacttcgattcccggaatcggttctttttcaaggaaattgttaacgtattcgttgacgtaagaaccacttttagtcttttcacgttcgttgtaagcagattctacggcttgcagatagttggcgcgtgcgcgttcatattctgatgcggtaaatccgaagcggcgtgcacgttcagcttcttccaaaactgttttcattgctaaatcgataccgtctattttgctgcttgcatcaagtgcgagggcttctttagtcttggcaaggaaatagtttccatattctgcgcttgcactagtgaaaggaggattagcagtttggcggagttcgttcaaacgattgttcagcatattcatagccatgctgaccatatactgagtagcataataagcaatggtatttttcaaagaatccggtgtagcgtcttgtttgaagaagatgttcacataaggattcttcacttccttgtctgtaccgatatagatcagcggttcctgattatctgccactggatagtagatacgttcggccgggtttaccggagcttttacatctgcgaatacttttttcagtttggcttcaatttcatctacattgatatcacctacaataacgattccttgcaagtccgggcgataccatttcgcataataatcgcggatatcctgataagggaagttgttgataacatcaatacttccgataggcatacagtctgaatatttagaatccggatacagagtagactgtgcatcagtcatgatgcgaagcataccactgttgcggcttctccattcttcgcggataacgccacgctctttgtcaatttccttgtcggcaaggttgatagcgctcgaccagtcgtgaagaatcagcagacaagagtctaccacgtttatattttcagttggtacgttgctgatgttgtacaccgtctggtcgacactggtatatgcattcaggttcgtgccgaatttgataccttttgtttcacaccagggcacgatgccaagtccggtttcatcacctgggaagtgctttgttccgttgaaagccatgtgctccagaaagtgagccagaccacgttgttgcggttcctcaagaatggaacctactttctgggcgatgtagaattcaactcgtttttcgggaagggcgttgtggcgaatgtaataggtaagcccgttgtctagtttaccgatgcgaacatttttgtccacaggtaattcttgcatgggttgtgcaagtacgagctggaaattgcagcatataaaaaggactgcaataaataatccacgtaataaatgtttcatgttctatttagtttaaataaatatttctgtgttatttgtcgttgtgcttggttgtaaatcacaaatagacagggaaaagagttattttatagcttcccgtatcctgactagcttagttaacagtccttccagaaggtctaactttaacatattggcaccatcgcttttggctacggcagggttttcatgtgtttcgatgaatattccgtcggcacctacggcgatacctgctttggcgacagtctctatcaactgcggcattcctcccgttaccccactggtttggttgggttgctgcaaggagtgagtgacatccagaatcaccggatagccaaatgactgcatttcggggataccacggtagtctacaacaagatcttgatagccgaaagttgttccacgttcggtaagcatcacattcttgtttccgacttccaccactttgtcggcagcaaactgcattgcctgcggtgaaaggaactgtcctttcttgatgttaatcgtttttccggttttggctgcggcaaccaacaagtcggtctggcgacaaagaaaagctgggatttgaagtatgtccacgtattcggctgccattgcagcttcatctgcagtatggatatcggttacggtggggattccgaaagtctcatgtacctttctcaatactttgagtgctttctcatcgccaatgccggtaaacgaatccagacgtgagcggtttgccttacggtaagaacctttgaatacataaggtatttgcagtgcttcggtgatctttactactcgttcggcaatgcgcattgccatttcttcaccttctatcacacacggaccggccaacaggaaaaagttgccggcggggttgttcttaagttctatcattttattatttaccaattacaaattatcaattagattgtgagtatatgtttctctccttgggtggagtgatcctgattagttggggatgataagcgttgtcttttccgggagcacgcctacttctaaaggaaaatgtttaggcaacaaacgcccgtccaaatccaccgctgcattctgtgcccggagtacctttacttttctcgtccggtagcttttcaccactttgtgattcaggattcttccctgaatcagcatccatagcccggaaataatttgcaggaattccgggcggtagattacagatacatccagccatccgttgtatggaacggcactgggagtttgtccccatccccaggcacttcctatacatacggtcatgatgcgtccgcggatatgttcatcattgatgcggagatgcattctgtaaagtttccgttcgaagatgagggagaacagggcggcaacgtatgaaaggaacttcacaccccagaaacgtttggtctgatcggtgattttgacgattcgtgctcccagtccgatattaacggcattgaggaaatagcgacgctggtgttcgtttccgtcgtagaagttgcagtagcctacgtctattttcttcaaccgatgattgatgatacagtcgacagccggcttgtattcggtactaagtccccaatatttggcgaagtcatttccgataccgttcggaatcatgccgagggcgatgttctctttgtcttcggcatcggatagcataatgccattgatggcatcgttcaatgccccatcacctcccacaatgacaatcgtgcgataaccattgttggccaagattttagcgagacgctctaccgaaccgaaaccttcggattgtacatagtcatagtctacacctttactgtccatgtactccttaatttctttccagcgcttctttacctttcgggtaccagctttggggttgtaaatcactccccatttcttcggttctacactcatatttgtttatctatcctattgtgtattaaaaatcgcactataataactgccaaagatactaattcccttgcagtttctcttttacaaaagctatcttttcttccatcggcagctctgcattcatccaatggatcgtaaatcctcttctttccatgccgcggaaccaggtcatttgtcgcttggcaaactgatggatggctatctccaaaccgttgagcatttcttcataagtcagtttgcctatgacgtataatgtcaggtatttgtattccagtccatagtagatgagatcgtccggtgcaattcccagttcgatcaatcgtcttacctcgtccaccattccttcatccaatcgttgtttcaatcggcgggtgatcttttcacggcgcagttcccggtcaatgtccactccgatgatgagactgttcagttccgggaattccctttcgggaaccggatgggctgcataatactcttcaatttctatcgcacgtatcgcccgtttcacggtatccacgtcggtggagttatgcaaagccttgtattgacttagcatttccgtcaactcttccagcgaatgatttgccaaacggttacgcaattccggattttccggtacgggcatcagtttatatcctttcaacacggattccagatacatacctgtccctccacataaaacgggaagacagcctttttgtttgatgctttcgtaagaattcaagaaatcacgttgatattcaaacacattgtatttatatccggggtctgcaatgtcaatcagatgataggggattgtacgtccgtttacggtatagtcggccaaatcttttcctgtaccgagatccattcttctatatatctgacgggaatcggcactgataatttctgtgttgagttcataggccaaggcagcggcaaagggagttttacccgaggctgtaggtccgagtatggcgattaaatcatagtccggcatagcttcattcttttatatctgcaaaattacgaaatatttttaacctgtttggtattcaatcgcttttttatcaagattaataaggggatagggaaggttaatttgcattttaacctctaattggtggtattcaatctaataataatgaagtgtatgagaataccgccatctgatattatctactataatatttgtgttgtttttattgtcaatctgtcagggtagtggctaatcttttgatttttagtggaatatggctgatgataggagctgacaataggctgacaataaaggtcttgttttttattgtcagctttgtttttgctgattaaatagtatagctatttgataaacagttgtttatctccttttttatcatgatgctatttttgtgataacttctgtatatctgtatgtttttacgttatattaccactaaggttgtgttgaaaaatcaggtgtgataactctagtatgctgatagaataacacggagatacgggtaaagtagcttaaagatactggcattgttcagctagagtgcctttattgttcagctaaagtaccgctcttgttagttctccacggccgtggtgaatgaatgatatcggtagcttaacagatgtatacctgcttgatagaataaagataaaggtgccttaatagagttgtgcttacttgcgtaagtctataaacctgacattcaaaatcttttccacatttatctgttgttgatcgtttgtactatccggcatacctttccgtttttatccacgccttctatggttatatcttccggtgcagtgctgtccggagtatagtattcgatggttgcttttccattagcatccagttgaagggtaggattccaatagatcgtacttcgtaaatccgagcgttggtcattcttcttttcaggcgtatcataagtaggatgatagaactcgaccgagtcgctgtaccccagtggagtacatgtgataatgccctgtgccggtcttgccgggatatctttgccgtctttcagcgtaataacgatagcacctgccgaaccgcgggaacctaagatcgctgcatcggcaccgcgaagaaggctcaagctcgacatatcactggtttgtatcatggtcaggatgtcgttatcgtcttcatacaccacgtcgtcaacaacaatgacaggttgctcgggattgttgcggatatgtatttcatttccatttgtcacgctaatgcccggaagtctggtgactgcatcaaaagctgtttgtgcaccgaatccttccagtctgtccccttcgatcgtgtaggtgttgatacctcctgtgtaaatactttctgaactggcctttttacgacttccagtgactaccacttctttcagattgtacactctcattccaccttccatgtaatattggtcgcgggtgttgagcaaataatcttccataaacgttgctgttccatcatggaaaggagacttgtgcgaagttgccgggtattgaggagtgtcaatcacgatgtccactccggcaaatcctcttttggtacgtgcctgaacaaggaaagtcgtgctatctctgaaagatgtgttcacgataaactctcctttttcgtctgtggtggtagtggcgatgatgttctgtttgggagccagaatacaaataggtcctttcttaacgttacctccaaagaaacctttgatacgtccgctgatagtttgccccttttccatatagttggtgaggttcattgaaggtgcagtcagtacattctggatatggtgtctgcgccatccgtgcgtcatcatcaggaagtctaccgtgcggagagtccggaggtcttgctgcaaaaaataatatccgggattttctacatatccttttaagtcggaggtcaatagaaaattcgatacgatattgtcagcaagcgaatccgggcggatactctttctgtcggtaatgctgatggaaaaactaccttctaccggagtaccgttatcgtcttttgctgaaatttgcagggataccttttctctttttccgtatgtcggcttatctgcaagaatttgccattgatgcggattccggtcgggtatgaaaaccaggcgttcgctaagtgcgttgccctgttggtcgatcagcatgaaatgggtgatgcctgcgttgaataaactgtcgttcattcttccaaaagtcctgtcgatactgactggctgcaggatgaccagctttccacgagtgtgcgcaatcaagaataacttttgaggccattcggtagcttctgttttctggatttcgtaacggatttcctttttataatgtgtcatggaaagtgtgattcctttttcttctacagctgggaggtcgaatcgtttactgataccgtcaccggatttggcaatcacatagtaagagtttcccacagtcggattcagtgtgaaaactcccatgccgtcatgctccgagcggaaagctgtcaatgtgtctccgttggcatcgaacaggaatccttctatttctgtagaaaagccatccgatccttgagccttgaaagctatattctgatgagcaacggtcaggagagcacctccttccgggaagaacttaacatcaaagtcttttgtaaacgaaggcagatagaaagtctttttataaatatattggggatcatcgaactctacttcaatgtggcgtgtggcaataggcttcaaatccggcagggaaatagaaatcaacccattctcgtctgtctttcttttacctttatctttaatctttccgttttcaatgtagcggtagcggatggcagtatttccgaaagcctcttgggtattgctggtaaatcttaccttggctgtataatgtgattcgtcttcttgctgatactcaatatttgaaacaatcgtattatcaatcgaattaccgattttcagattgcgtgaataaaagaattccggttcctgattaagcatccagttgctatatccccgcaaataataatcacctgcagggagagtgggagggagggtgaaagcattatgaaaacccaatgaatctctgcggatctttttccgttctacaatagagtcggaacggttgacaagctctgtaatgatgaagttgctttgtgtattatcttgatgtgtaacagagtttaccagatatcccttgaaccatattttttctcctgccccataaaagggcttgtccagatgtaagtagagtttctcctgtgggattttttccagtagattaaaatacgcaataattgtatcttgtacgttttgccctgacaatggggcaaaacagaacagtattccgaaaaagaaagctattaagcctctatggatagaaaatgtagttttgtttttcatacgttatgtgtttgattctacatctatgatttgtgcatccagatcgaaagcactttcttttttactgccagtatgttaatcaccgatacaacgataaataatagaatacccatactgattgctgcccataatgatccggtttccagctgtggaaataggatgcggatgctgtctatgtaataactgcgcaaccaggagactaatccgatggataatacaagcacaataacgttcaatcctaccgtgagcaactgataaggcaatgctaccttgttgggactgtatccgattagtaatagactttccagcttggttgtattcttttgtaaaagcaggaagatgctcaacatcagtatatagaatgaaaggatactgataaataaacccactcccaatacaatacctacgataagacggaggaaataagttgtttttccggcatccagcttaccatcttccgtttcatatcctttcttctgaaaataactggcgatggcggaatctgccggattgctaacctcgataatcaatcgtgccggttgggcttctgcattcggtgcgaaattctcattagcccatttcataaaggactggggaacaagaatcgtattcagacgattggaaaaaccgacaatgtttcctttgtactgttccacccgtccgttgccacgcatcataatatccatttgaatcagactcattaacccttccgatagtttggggaggctgcggctttgcgcaaaaccgaagttataaaggttcagatagttgcgcggaatgataatgggtatggtatgtgtgttttcatcgaaatgccatttatcgagtttgatgtcgacaaactcatcgggaacagactcaaaaaacatatctgtggaaagatgaataccggcttccttcattcccaatcctgctgaaactttgaattgagaaggagtgaaagctcctattgttttggtaaacggttgctttttcagatccgcaatttcttcggcagagaatgtattactctttcctgcaaaagaaccgagagcactgattttctttgtagctatgatgaaatcctttttcataaagctgtctccttcggtgaataccggaatgacatctttataaaactgtacgctaagcaatacaatcatcatgccgaataggttggctaaaaagaaaccggctaattgaccgatactgatatgttggcggagaagcttccagacaagagttggcattttatttacgattttacaatttacgatttgaaatgatgctgtgaaaaagaggttgttcattacctgctacctgttattaaccagcttactacagttgaagtgtatggctgtaaggcaactcgatatgtttaccgatggaagtggcgatcactccggctccttgtgcctttgcttcagcgatgataagttcacccatgatgcggctgttatcatcgtccaggtggctgatcggttcatccagaaataaaaagtcgaacggctggcagagcgcccggataaaggcgacgcgctgttgctgtccgaaagatagcttgccggctttcacatttattttatctgcgatccccagttgttcgaagaacgataagatttcttttttctttttgcatccggtgaggttattcttcaattgcacattttcaagagcgctaagttcggtgaagatgcgtaaatcttgaaaaagcatacttagtgaatgctttcgcaggtcgacccattgcttcacggagtatgctttgatattggtttcatcgaaattaataatcccctgatagtcgttgcggtagccatagatatagctgcacaacgaagatttgccggtgccggaagcagcttcaatcagatacatttctcctttccggaagaaaagatcctgatgccatacgtccgaagtcaccgaattacggtcagcaaacacttggggaagtgtttgctgtaagtgaatactattcataccgttggtttatacatttattacatgccggcaaattgcttggcaaagtctacaatttgtttgagggcatttacatctttgtctttcaggcagaggtcaatctcgctgacttccccttctgaactcatggacaggtaagaaaccttgttggccagttcgatatatgtcttagcttcctgtcctccgaaacctgctaccattttaacaataggcagatcgaggattgcttcggcattgattgctataaataggctctttcccttcatatccgatgcataaggagcatctttgactgatttgtcggcagctttacctacgtttttgtagagtaactcatcattggttgcatacatttgtttatccttgatgccgaagaatatattcatgcctcttgtcttgtagacatattcgtctttgccaagttgcatgatatcttcccctctcttcaatcccaatgattccttgttcttgtaaatcatttcaagagcattgccgttcttcacgtcagcgtacatcatgaaagtgggagcactgctcatcgttacgttgattaatcctgcagaaatatcaccattgaacgagctgaacaactcttttacttcgtctgccttagcgatagatactgtgttgcggaattccttgttttcgctcaacaggttatacagttcgcctccttttacacctacgttgaagaacatcagggtagaagccgggaagtatttaacgaaagtattattcgcttttccaacagattccatttgtttttttaggagagctttcactgcttcgttttcagtatagttttctgttttgagggcaatctttcctttttcaaagttcagtcctcctatcagagtgatgtcttccgctttcacttcagtaggtaatcccatggttatctgatcgcggtaggttgaaggaatagctgtcatggaagcaaagaagttaatatcacttttctgtttctccattttctggaaagctcctgatttcacgatactattgcttgctgtctgtttcaacaaattagtaatggcttctttggctttatcagtttgagttgttccgctgacattgactaccaatatagtagaactattgaaaacaagcaaaccgctgttcatcgttgtaaaactgtaaccgtcagcttcgcctaccggttggcagatctgttcttttgccatcacgtcgagtgaagcatgcaacttatcttcattgttcactttacctacaacagtaggataagggaaagaagatgaagagaacacatagaatggagattcaacatcgattcccgattcgcccggattcttcataaccttttccagttgttggaatgtggccgcattcattccgcttttcagtgcttccagtactttttgtttagcagcttcattctctttatcatccaatcccgctttgcttgcgagggatttaaggttgatagaggcaactaccgaagcgtcagccggtatcacatttgtatattccgatgttttggaacatgctgccagaaaaacaatcagtactgccagtaccgagagtcgtgaaatcgttttctttgccatacttatgttatttaaaagttgtataatcattgattcagacatttactgctgttattgattttgcagattcagcgtgtggcaggccaccaatgccgctgtttctgtacggagccgtgatttgccgagactaatcggaacgaatccccgttcgatggccttcttcacttcttcttcactgaaatctccctcgggacctatcaggacaagggcgtcttctcctggtttcagaacattcttcaatagaggtttctccccttcataacagtgggcgataaacttctgtcctttaaactcctgcctgatgaactgatcgaactcaatcatttcgttcaattttggcagtcgtgccttgagagattgtttgatggctgataccagaatcttttcaatccgttcggtcttgatgactttacgttccgagaaacggcagttgaggaaagtcagttcgttaaaacctatttcggtagctttctctgcaaaccattcgttgcggtccatattcttcgttggtgccatggcaatgtgtaaatggcacggccataacggttcctgaaaaatggtttctttgatgtttacgaaacaacgtttgttggttgcaacagtaatttcagctttgtagaagttacccttaccgtcggtaagcgtgatttcgtctccgatacttagccgcagaacacggatacagtgttgtgcttcctcttcgggaagctcgttgcttttctgtatatctggagtataaaatacgtgcataatattacttactgatttttatttcttgaattgatttgatcgcgtatctgcgcggctaactcgtaattctcatctttaatagcctgttccagtgcttcttcaagcgttctggaagtagcaccgggcaaatcatgttcttcttcagccacttcgtcgttgtccgtttcttcagaacgggttctttcttctgacgacatgtgaagacattcctgttcaagaatagattcataaataagaatcgggcagtcggcacgcactgccagggcaactgcgtctgaagtccgtgcgtcgatacgtataatttcttcgtcttttttgaggtaaatataggagtagaaaataccatcctttgctttgtaaattaatacacgtatcaggctggctcccagtatagtaagacttgttataaataaatcatgtgtcaacggacggggagttttcactcctttcagatataaagcggtagcctgggcttccgctggaccgatgatgataggcagttgcctttcaccgtccacttcgcccaatagcatagcaaacgcgcctacttgcgcctggctgttcgtgatatttataacttgtaattctacctttttgtccatcgttctcttttacttaatttgttttactctcctgctggtgtttgtacttgaataccaaggcaaacagaatgccgattaccagcgcataagcggcaaagatcagccaaatgttcatccattcgcgactcaccagtctgccgtcggcatatacagagaatgcatcaactaccgcaccgctggcatatccgcccatgatggctcccaatccgttagtcatcataaagaacaagccctgtgcactggcacggatagaagatttggcttcttgttcaacaaacaacgaaccggaaatgttgaagaaatcaaaggccataccataaacaatcatggaaaggatcagcatccatagtcctgatcccggatctccaaaaccgaacaggccgaaccggaacacccaagcgaacatactgattagcatgacttgtttgattccgaaatgacgcaggaagaaaggtatggcaagaataaacaatgtttcggacatctgtgaaatggataacaggatgactgaatgtttcactccgaaagaatctgcatattcagggatgctggcaaaactgcctaggaaaaggtcgccgtaagtattcgtaatctgcaatgctgcacctagaagcatggagaaaaggaagaaaatagccattttctttttcttgaataacaccagcgcatccagtccgaaagcggagagccatgatttgttttcagatttagccggtcgacaggccgggagcgtaaatgaataaagtccgagtagcaatgcggaagcacctcctacataaagttgtgcacttgaattcttgaatccggtaaggtcgacagcccacatggcacaaataaaaccgattgttccccatacgcggataggagggaagtctttaatcaggtcacatttgtattgctccagtgcattgtacgataccgtgttggcgagggataaagtgggcatatataccaacaagttgagtaacatggcccaatacatctggtcgtatcccgttgcggtggaagcgtagaagagacatcctgctcctgcaatatggcaaagtccgtataaacgttctgcattaaaccatttatcggcaataataccgataatacccggcattaccaaagaggcaatccccatggtggcgaaaatggctccgatttgtcctccttcaaaatgaagttctcttcccatataaccacctaatgatattaaccatgacccccatacaaagaattgcaggaagttcataataatcaaacgaacttttatactcatgacttttttaatttgtgtttctcttcacattcataaaccttgcaaatataatattttcgttgaataggtggataagtaatttgataaaaaggggataaaaatggcataaatgcgaagaaaagatgagatttgggtgtgaaaaaacaaatgaagggggtataaaaaaaagaaggctatctatcccagacagccaatctttgttaaccttaaatctaataccatgaaaaacacagtgcaaagatatagggtttatgttatacaacataatgttttctcgaaaatcttctatttgttaactctaattaactttgaatcttccgtttttctgttactgccctctctaatcagccatacttccggagaaatgcctgatatccgaatggaaacttggctccggcaccttgccggttattctacgtagagtaccaatcctttcagatattctccttcgggatgatagatgtttaccggatggtcggccggttgagtcagctggtgtagaatgcgtacgctacgccctgacatggctgctgcggtaaacacagcagtacggaaattatctttgcttaccacttgcgaacaagagaaagtaaacaggatgccgcccggtttgattttctcgaatgctttggcattcagtttacggtaaccttgcaaagcattccgcagtgcatctttatgtttggcgaatgcgggcggatcaaggatgattaaatcatactggtcgcccatgcggtcgagatatttgaaagcatcctcggcaaacgcctcgtggcgggaatcaccggggaagtttaattccacgtttttgttagtcagatcaatcgctttggctgaactgtcgacagagtgcacgagtttcgcacctccgcgcatggcatagaatgagaatccgccggtgtagcagaacatattcagtaccgaacggtctttggcgtaacgttccagcaaagaacggttttcacgctgatctacaaagaatccggtcttctgacctttcagccagtccacatggaacttcaagccatattcttgtgcgatattgtcactgcttcctcctttcagaaaaccgttttcggggaaaaggtctgccttaaaaggaagagttgtttctgatttataatagatattttcgattttgtcacccattacttcggataaagcttcggcaattgtcatgcggtctacgtgcattcctgcagagtgtgcctgcataacagcggttttggcataaacgtcaatcaccagtccggggagattgtctccttcaccgtgaacgagacggtaggtgttgttggtcggattagtggcgatgccgatactgcgacgcatatcgtatgcaatttccagtttgcttttccaaaaatcgtgatcgataggttcctggcggaaagacagtacgcgtacagcaatacttccgatctggaaatgtccttcggcaataaattctttttttgaggtgtacacttctacaacttcaccttcatcgggctctccgtcaaaacgagcgatagcaccggaaaaaatccaggggtggaatctcttaagagaatcttctttaccaggtttgagatatactttatgcataatgtagtctttcctcaaccctctcccaagggggagggcttcagatcgttttattattggttattaatcacttattttattacttatcacttcttccgcgggagagacagtagctgtcagcggagaaacctcccaatctcccgtctgtttcagttcttgcaacagattgtagatattgaggcatgcccatgcatcggtagcagcgtattgtttctgtccgtcacttaatacatcagcttcccagttggacaagcgttgtgatttggatattttttctttgaataagatggcgtaaatcttttgcagacttttgtcctgtattccgaattgacgcacatagtcctgtaattcgatacagctttgttgggtgaaaggtgcacgtttgtgcagcatcataaagtcgtctttcagtgaaagtcccactttgattacagccggattttctaacaagtcaaccaatggctgagtcaatcccgtcatattgagccggaataagaaacagcattcttcggaagaaatctggagaagtgctactttgtgcgattgtcctttggtaaaggaagggcgagtttcgctgtcgatacctatcactggtctggattggaggtaagctacagctttttccgtttcagcttccgactggataacataaatacgtcccggaaagactgttttcgggagttcttttagttcatctttatctatggttcttcttacaatcatttttattttaattcatcatcgtggcaatggcaaccgtcttcgtgacagtggcaatcatcatcgtggcaatgacagccatcttcttcacaacaatcggtgtcgtcgcttggttcgtaaaatccttcttcattacctacttcctcttcttcttcctcctggttgtatttcacgtcatgaagggcgcgaagtgtgtttaccagtttctgtccccacagtgtaccgaagttttcctggcagatggccaatgaatcattcattgtttcgttcagtcccagttggaagacaaatatgaaatctttaatatcctgataaatgtcggccaggtcttccgatatagacttcttgataggttggtcgctatacaccatatcttgcacgaatacgtccagataatcatccttgtcagccatcaatccggaaaggttgatacgcagaatttcgtaaatctcttctgtgacatacgtttcaagtgcttcgtccccgatagtctcacatttgggcagcatagatgctttgagatagagtagtggaagtatttttaatgatgtatcaacgaaagtgctacgcttcatgcgttcggcacgttcgagaaatgcacaaaattcggcagctaccgttacgaactcaattacgtttttatcaaatatcgtttggctttctttttccatgatctatattgatttgaaacgcaaaggtaagaaaaaggattgaatgagcgtagtgctcgttatttttttattatttttgcagcttagaatctcattccagttttataaaaaagaattaaagactcatggcaaagaagaaattagataaggaggcggaacgtactccctcttcccccagtaaaattgtggctgtatttaagaatgaaaccattcattttgtaatcggattgatgctggtcatcttttccgtttacctgttgttggctttttcttccttcttcttcacgggggctgccgatcaaagtattattgatagtggtagttcggcagatttggcagctgttaataatcaagtgaagaattatgcaggttcacgcggagcgcagttggccagttatctgattaatgactgtttcggcgtttcctctttcttcatacttgttttcctggcagtggcaggattgaagttaatgcgtgtacgtgttgtacgtctgtggaagtggtttatcggctgcacactcttgctggtctggttctccgtattcttcggatttgcctttatggatcattatcaggattccttcatttatttgggaggtatgcacggatataatgtcagtcgttggctgatttcgcaagttggagtacccggtgtgtggatgatcctgttgataacggctatctgtttcttcatatatataagtgcacgtaccgtcatctggttgcgtaaactcttcgcattgagtttcttgaaacgcgaaaagaaagaagaaaaggagaatgttccggaaggagatccggaatttacgacttcccaaccgcaagaagtggagttcaatttgaaacggacgtataaacagacacctcctccggcaccagtgatggatattcaggctgaagaacctgaagacgactttcctattaataaaccggaaaaggaagatacttccgtatctgacgaaagtgaaggagtgactatggtatttgaaccgactgtttccaatcctgttcctattgtgcaggaagactctttggaagaggcggaacccggatttgaggtggaaccggcagcttcggaagaagaataccaaggacctgaactcgaaccgtataatcctactaaggacttggaaaactaccgtttcccgactatcgatttgatgaagcattttgaaaatgatgatccgacgattgacatggacgagcagaatgcaaataaagaccgcatcatcaatacattgcgcagcttcggaatcgaaatcagtacgattaaagcaaccgtgggacctacggtaactctatatgaaattactccggaacagggagtacgtatttctaaaatccgtggtttggaagatgatatcgcattgagcctttccgctgatggtatccgtattattgctccgataccgggtaaaggaactatcggtattgaagtaccgaacaagaatccgaagattgtttccggacagagtgtgatcggaagtaagaaatttcaggaatccaaatatgacttgcctattgtattgggtaagacgatcacgaacgaagtctttatgttcgacctttgcaagatgccgcacgtattggtggcaggtgcaaccggtcagggtaaatcagtcggtttgaatgccattatcacttccttattatataagaagcatccggcagaattgaagtttgtgctggtcgatccgaagaaagtggaattcagtatctattcggtgattgaaaatcacttccttgccaaacttcctgatggaggcgaaccgattattacggacgtaacgaaagtagtgcaaaccctgaactctgtttgtgtggagatggatacccgttatgatcttttgaagatggcacatgtgcgtaatatcaaagaatataacgagaaatttatcaaccgccgcctgaatccagaaaagggacataagtttatgccgtatatcgtagtggtgattgacgagttcggagatttgattatgaccgccggtaaggaagtggaacttccgattgcccgtattgcacagttggcgcgtgctgtcggcatccacatgattatcgctacacagcgtccgactactaatattattacaggtacgatcaaagccaacttccctgcacgtatcgcattccgtgtatctgccatgatggactcccgtaccattctcgaccgtccgggtgctaaccgtttgattggtaagggtgatatgctcttcttgcagggagccgatccggtgcgtgtgcagtgtgcctttatcgatacgccggaagtggaagaaattacgaagtttattgcccgtcagcaaagttatcctactccgttcttcctgccagagttcgtgagcgaagatggtggtagtgaagtaggagatattgatatgggacggcttgatccgttgttcgaagatgcagcccgactggtagtgatccatcagcaaggttccacttcgttaattcagcgtaaattcgctatcggttacaaccgtgccggacgtattatggaccaactcgaaaaagcgggaatcgtaggtcctacccagggaagcaaggcgcgcgatgtcttgtgcatggatgataacgatcttgaaatgcgattgaacaatttacagtaaccgttcgtttattaatcaaatgagaaagtacatttttagtgttttaatagctttactgtctttgcctgtgattgcccaacaacagtcgcaggctaaagtcattcttgacaagacggcagaggtgtttcgtaaagcaggtggtgtaaaggctgattttactgtaaaggctgtgacgaacggtctggtagaaggtgcagaaaatggaacgattcagttgaaaggagagaaattcgtactgaaaacgtcggatatcatcacttggtttgatggaaaaacgcagtggagttatgtgacaaagaatgatgaagtgaacgtcagcaatccgacacaggaagagttgcagcagattaatccgtatacgtttctatatatgtatcagaaaggattctcttataagttaggagcaactaagacgtatcgtggaaaagccgtttgggaagtcgttttgactgccagggataagaaacaggagttggaacatatcactctttttgtgacaaaggatacttatgaacctttgtgtattttgcttcaacagcgtggtcagcagacgcgtaatgagataaccattacaagttatcagactaagcagaattatgcggatcaggtttttacgtttgataagaaacaataccccaatgcggaggtaatagatttgagataatatacgtttataacaaaacgataaagataaattaaaatggcagaaatagaaaaagtgaaatgcctgattataggttcaggacctgccggatatacggcagcgatttatgcaggacgtgcaaatttatgtccggtgctttatgaaggattgcaaccgggtggccagttgactactaccacggatgtggagaatttccccggttatccggaaggaatcagtggtccgcagttgatggaagatttgcgtgcacaggcgagccgtttcggaacagatgttcgtttcggtattgctacggcggccgatttgagcaaagccccttataaaataacaatcgacggtgataaggttattgaaacagaatcattgattattgctaccggagctactgctaaatatctgggactggaagatgaaaaaaaatatgccggaatgggtgtaagcgcttgtgccacttgtgacggatttttctatcgtaagaaagtagttgccgtagtcggtggcggtgatacggcttgtgaagaagctgtttatcttgccggacttgcatccaaagtatatctgattgtccgtaaacctttcctgcgcgcatcgaagattatgcaggaacgagtaatgaaccacgagaaaatagaagttctttttgaacacaacgcagttggtttgtttggcgacaatggggtagaaggtgtaaacctggtgaaacgttggggcgaaccggatgaagaacgttacagcttgcctatcgacggtttcttcctggctatcggacatcaaccgaatactgaaatctttaaagaatacgttgatacggacgaagtgggctatatcatcacggaaggtgatagtccccgtacaaaagttcccggagtttttgcggcaggagatgttgccgatccgcattatcgtcaggctattacggctgcgggaagtggttgtaaagctgctttggaagcagaacgttatctttctgccaaaggactcatttaatccggtttatatccgaccataggagggtattaaaacccttataaatatgaaaatcacccacgctagagtttaatctgtagcgtgggtgattttgttgagaggggagtcttgctcccctttattttataaactcaaagcttttcgaacaatatttgtcgattgtctttggttaatacgcttctatttcatctatccataattcggcaggaatgacttccggcccgttattcttttcaaagttgacaccattacgcagtgtgccaccattcttgattttgactttcaggaatgtagcctgtgccggttcaaactcaatggaatcggtgaatgcaattcttcctgtttccggataatcgtgtttcaaagctttttcggctatccgtgtgtattgcttgccgtctgctgatacttctacagcaactcctcctgcaggaagaattctcatggcaggattgaataaagaaccgaaaataactttgctgacttgtgtcggtttatccagatgaacgataaattccaagtccttaccctccacgatgccaaaactacaccacggagtataagaagcattattgcctcgtttgccgttggtcagtccaaaggtggttttgtcagctcctaatacatcgttttcatcgaatatatcgcctgtccatcccatcgtataattaaccgtatagggctttcctgtcaataaattgccatacagtggcttgtgagctactttgcccaacatctttccgtctttgaaagcagcggctttcaggtcgatattaccttcaagaacgaaaggcttttcatataagatggacactttggacggttcgctgccgtccgttgtataccggatttccgcattcgggtagaaactttccagcaataccattaaagggccgttttcatctgcgtgcgtatttatatttacgtcatagaagttgagacaaggttgggtgttcataactttcaaacgttcaaattcagtcaccatccgttcgcagaaattcttccagtctttgtttgcgttttgtgtccaggccgtttcggcgatagccattgcacgtgggaaagcctggtagtctgtacgttctgaagtctgcatatattctctccaaatattaccttgtattccgatgatatgcttcttagcaagctcgtcagcgtcgtccggaacagggttataactatatgttttcttcaaggtattgtatccgccaatagtagtcggagcaatttccggctcttcctgatagtagtccagatatacataaggattcggagtcatgatggcattatgtcctgctttggctgcgttcataccgccttctacaccgcgccatgacataacagtcgcattgggagccagaccaccttcgagaatttcatcccagccaatgatgtttttgcctttgctattcaggtatttctccatacgggtaacgaaatagctctgcaacttatcttctttgctgtgctttattccgtctatcttactgggagttgtatcatctttcaaccctaactggcggattaactgctggcagaaagcactgttcttccacgctgtcttgggacattcatcgccaccgatgtgaatgtattcgctggggaataattctataacttcatccatcactccttcaaagaatttgaaagtcgtttcactcggacagaatacctgttcgaatactccccaggtaggagatactttgtaagtctgtgtagagtcgcatgacaattccggataggcggcaagtgcagccaatgcatgtcccggcatttctatttcgggaacaacattgatgtatttacttgcagcataagccactacatctttgatttgctcctgtgtataataacctccatgttcttttccgtcgaatacttgcggatagtttacatagtaatagtctactaatgtcttttcacgcttggaaccgatttccgtcaatttgggatatttcttgatctcgattctccatccctgatcgtctgtcaaatgccagtggaagacattcatcttgttcatagccagtaagtcgataaacttgtaaatgtagtctatcggtacataatggcggcatacatccaacatgagtccgcgatgaacaaaacggggtgaatcttcgatttctacggcaggaaccgaccagtcagctttcttatccaactgctttccgtaaattgccggagggagtaactgataaagagtctgcactccataaaagaatccgtttggctgggaagcggtgagtgtaatgagactgggagtgaccgataatttataaccttctttcggcataccttcctgtacaacaaaagagatcgccgtttttccatctgcactttcagcttctttcaaggagattcctgctgtcagttttagttgttcggccaggctgtcggcaatgctttttacttccggagcatccgagagaactacgaggcagactttgttgtttagttcaaagcgtccttcctgtggaagaatctggttgggtttgggaacgatgttgtactcgttcgccgcttcttttgtcttctggcaactgggggtaatcattagcaaggacaaaagaagaagagaaatacttttcttcatggtcaaaatgtgtgttaagttataaatagatttgacagggcaaatgtacttgtttatatgataagttccaataatatggaaataaaaaaagccggaatgatgtccggcttttagctaaagtttcagattaatgtagttatataattaagagagagtttttatttcagtagttgctcttcgatgatttgtacgtacttctccggagtagctccgacttcaataatcggtttgccgcctgcaggtatgaagaataaggtaggcaatgcctgtacaccgaagtgattgcataaatccttttctttgtccgcattaaccttgtagaatacaactttacctttatacttttcagccagcttttccatttccggaagtaagcgcatgcaaggtccacaccaagttgcccagaaatcaattacaaccggtttgtcgccattataaacgaaatcgttcccttttctgtagtcgaagatgtgttcgaggaagaattggcgggtaatcggattcagtttaccgtcttcaactttagtttccgttactttagcttccgcttccggtataggaaccatgtcaaacggctggaaataaattttctgatgaatatagtcaatggatatgattccgtagtccaatatctttttgcctaatacggagcgtttcaggtatggattcttcactgccatggcatcctcaatctttgtttttacaaacatggtttcaggtaagatgaggctttcctcttcttgagtcgcttctttatatccattggaaactttttggttggttcctttggtatattgtgtgctccatgtattgaaatctttttcggtaagattcactaatccttcgctccatgtatccagaacaagagaaacgggttttccctgaatggatatcggacatacgattcctaatcctgtaattagctcaaagttctcccggtagtttaatttcatgtaagaaggacgatagggctgcgtaattgtgagttttttccgctgcatatcaatagtcagaacggaagtgcggaaaatagcaccgcttaatacacccatcactcccagcttgcgcagatatggttcgtcttccagagtgaaagcaggcagatcgttgttaaacgtgttgttgccaatagcaactgttgccatttcatatacttttccaacaggtacttgtttgaatacaaaatcctgataagcactaaaagtaccgttcttccccgtgtcgatgcgtaacttcttgagagcctcaggaagcagggcgttatgtcctgacagatcgaggacgaagtctgccacttcgccattaatggcggcttctacgataatctttccatcaatggttttgaatggaatgacctctgtcatactgttctgtgtctgtgcactgattcctccggcaatacaaaatgcaagtagacagagatacatctttgttattattcgcttcatatcttttttctgtttaaagttcatttctctttcctgatttcaatctttttctcttgattgtctttcttgacaataatataaccggtatcaccggggatggcgttcatgatatcttccacagccatttggctcatgggacaatcgtccaaagaagtaccgttgatattaatcacctggtcgccgaaagcaactttatctttcatgctgtcccagatcgttgtaatttcgaatctgtcattgcgtggcagaatactcacgttccagagagcgggagcaccgcccatgtcggtttttccttcttcaaacgggaaaaagtagaatcgtctgcgcatataatcgataattactttaccgtattccagtaaatccaccccgatgatgcttccattcatcactgtggtcgtactacccacgttcgtgaattctttccccatgatgttgataggaggaacagtcaccttctttatatccaccggcttgcctagacctgttattccggcagctacgataccatatccatggttagtaactttcgaaatgtcagacagcctttcataatcttctgtagaataaagcagaaagcctcccgcacctgtatcgaacagaaccttgaagtcattgtcccctaagcggacattgacaatggagtgatgatccgtctcatccaacagcggaatcccatccgttacttttagtccttcgggacgatacggataattgataaccattattttagaacgggaatcgaatgtgactaccgactgtgcgaaagcgtctcctccaagaataccgacaacccctagtccggtgaagaatggattcttaggcagtaccatcgtcttcaactgcttgattttatagttttccccgatagaaacattctgtacgtgcgcttcctgataattggagccttgtgcattcacatcggagatacgcatatatcctgcggcagtagctttcatttccgttgcggcatcatacatcgttccggttcttcctcccgtatcgacgatatatttcacttttataccgttaacagtgacggggataatgattttctcttgtataaactcataaggaatggtgtcgcaaaccttattccggatttgcgctgccattctttgtccgcagtttagaaataatagcagccataagccggtcagtattcctatacttttcatattattctttttcatagataatatcctttactccggaagctgtctcaatcgtcagtttcgtcttctttttctcttttaattccggtattccgttcagaatactttcgcagaagtcatatttcttagcaggtttgccattgattttaactaccttgtctccgactgctatcttacctttcgtactgctccatacggtagatacaaacaaatctccgtctttgaccgttaagtcaaagttgttaccttgattgtttatttcattgtccggttgaaatgcttcgaaatagaatcttccgcgtggatagtcaatggtcactttaccgtattgcaacagtttgacgcccaataatgtgtaagggtgattgttggtgctggttgttacgttacggaatttggtggctccgactgatagcaatggaatacgaaccctgtaagaagaagctttgtccgcctggccagatactccgatactcccttctccatacccttcggaaaccacttccatagaggcttccagtttgattttttcaaaatcactttcgataagtgataacagactgggactacctgtatcgaataatacatttatattgctaaccggagctatttgtatgctgacgatcggcataccgccccctttggtgaaattcaacatctttcgtaaagacactgtcgatggcttttcagcagaggtaactataatatttttggcttgtgaatcaatagtgacaatggtgttggcgaataaatcactgccgatgatgccatctactccaaaacattcccagccttttacttcatcaatgaccagtgacggagcatttttgaaattaataacatggtcgggggtagtcaggttctctatccgggtagtcttgtaatagctttccacgttattcacatccgttactttagccgagtcggtggctgccatttgcagtgcctggcaggcttgagtcgtgagtgccgtacgtcctcctgtatcaaaaatgaaaggacgtgccgtgccgttcactttcatttcgataatcatcttttcacctaccatccggtaaggtatagttgccttatattgttgggcgaatacaggaaccgccatgcaaaaggcgacaacggttcctatcatacgagtcgtatacttcataagctaattttatttgctgactttttctgcttccaaaattgcctgataagcgtttacaatacctccggaaatacacaaatcatcgaaaaggaacaagtcttgtgaaggactgtcgtttacgcggattcctttttccacttccacccctttgcgtgaagtgacgctcttcagtagtatgtcacggatttgcgagccggttaatttagggaaatatgatttcactaaggcagctacaccggctacagtagccgaagccattccttcacctgtacctttttggtacgtatcacccatataggatgaataaatatctgttcccggtgcataaagatcgagagtagttgcaccgtaattggtgtttagtaccggatttccattcttatcagaagaagcaaccaccataaaattggtaagttctccgtcttttctcatcttccggttagggaagaattcatctttatccatatctactgacagatcccaaaccggaactattaccaatgctcctttcttttcagcttctttcagcgcatctgctacccattgtctctgttcttccgggtataacgaattttgttccggcaataaaataatatccgctccgtggtttactgcataccggatggccagtgccatatcttttaaataaggttctccttctcccggatgaatacgtaaagtcataatttctgcattatcggcaataccgttacttccgacaccgttgtcgcgtttggctgcgatcactcccgctttcataactcctgttgctgcgtcagacgtcaacagtacattattgccatattgtgtgtcgttaatatccaagggattatcacctacaatttctttccggttatcagttccgtatttctttaaagcatcttcataggacgttttggctgttgctacacttttctttcccatattttgatatacgggttcccatttatccgtattatagatactgaaatagtaggcagtaaacacaaaggcaacttctgaaagactgtctctttctgctttgggatcataacaactttggaagtcctcaacggttaactcttttccggggaagcgttttttcatgtccttatcgaacttttcaacatattcttctattacataagaaagttggagaccaccataggttcctccgattcttgattccggcatgactttatagcgatagtagttatattcttccatattttccggtacgggaacttcttggcgttttccattgacaatcttatagtacttttttccatcgaaaatatagtcagcatatttatcttttaggcggaaaaattcacgttctccttcgcgcgtcagagcttccattacttgaccgtctttacctccgatgaagttccagccattgatatcgtcaacaagcccgtttttatcatcatctttttggtttagtttttctttcgggttcatccagattgcatgtttcaggtcttcgtgttctacgtccattcctgttccgatcaatgcaacaaccggtctttttttagctttctttttgttagctttcagatactcgtaagccttgtttacttcggcaccatatacactgtctttgtcgaaagaacagttaaaccagtccagttcggattgtttcttttgtgtttctgcttcttgtttgactaactgagccgatactgtaatgctgataaaacagcatacgataggaaatataagtttcttcattgttgatgagttataatttatacaatctagttattttcttatttttaaaatggcttcacgcacctgttcaccccggacattacgtgcagcgagtttgccttctttgtcaatgacaacgaggaaagggatggagtagaaaccgtaagcagcctgaatagcgcttggagtcttgctgtttttgggaaatcctgttttatcccacaacatcacccacggcagtttttcttcatccagcatttttctccattttgcttcgctgtcatccaacgaaacactgatgaattctaaatcatccgctttcagatcattatatattgtcagcatactgcgcatctctttgcggcaaggatcacaccaggaagcacagaaatccagtacgacaatttttccacggaagtcttttaaacttacactctttccattgctgtcaatgaacgtaaaaccaggacattctgcaccgatgatctggtgggagagaacttctactttgttgattaaccatttggcagacaaagaattcctatcttgttccggtatcatatccaataacattttgttggatgggtaatcattcacatctgccagataagctaatgctgacgccatggcaggcgtcagtttttctttggcagaagtcgagattgttgctttatccggatctctttcggccggcatatagttttgtaaagtcagaaacggatcaatgccggtgaatgaaagtgagctttgttcgggattcttttcatcgaaaaagccattgatactaacagaagtattttcaaagtaaatgttttgttccgttttcccgatacatagcgtatatacgtcgggctggatctctttcttttctgtttcgaatactccgttctggctgatggaacaagtcaaaacaaggtttccattcaaatcttttacttgtaaggtagtaggtctaagtatccttaactttcccttaaactgcagtccgccgttgctccatagggaggaggtggtgcataaaagcaatagtattagtgagagtctttttattaattccataatattgagttttataatatatcgtaaagcaacgaatagctttgtcgttatccgtatctattttaataacttggttactactggataaagaaaaaagttctaccagtctccccaaggatcatcatcgtcatctcctgcatcagcttctggtagttccggataaggtttgatatcccattcttccggtccttgagcgatagcttccaggtcaatattgtatttttttagataattggttacaaactcgaacttactactcataaatggataggttgccgaaggccacattgcttcccgttcttccttagtaagacgcatggctatttgcatgtaaccgataaatgtttctttggctgttggaggattatcagaatgtggtttactatattttgctgataatgaatttacatcaccgggatagcctcttctaagataataattaggatcagctttgctttcaatatcttcatttctgacaatcttagttgaatggttgaatcctgcatcaaattcatcttcgggtacgataatgttacctctggtgatggctgtgtttataacttcatcaattattttgaagcgacgcacagtaaaactgtccttgttgccggcaataggggttttccatccagagattggatcatcataggtgctgtgagctgcatctccccagaagcaagttacccagcagtcagtttggctttcttcatgttcggataatgctacataatattctaacactcccggtacaatggaggcaaataccgagtaattgtatcccacataccaatacatgggaaatactctgtccgtaacttcccgattaagataagggaatatatgatttttcataaaagtaatatagaatgccgccatctcctcattgagacaattttcgaacactcttgtagagccaccgataccaccacctgtccaatttttattgaggtctttttctgtgatatctttatatattattttcactccgaagtcttggtagattttcatggcatcattgtcccaagaattatctccttggggaaactcaaatcctccggcctgtgcaagtgggtctggtgtcgggataattgaatcatcttcgtagcaagacgtgaatgtgagacagaacaataatatccatacgttatatattggcttcataattttctgttgtttaggattaacgatcattatttttataatttatagttagtttgttatggaaactccaacccgttccggaccgaacggattttgttccaatagtaagtttctttgcaatacatttggaggtataggtaatacgtatgaaggatcattttttgttaatgtgtaaatttttccttcccatttgtgctgtatggaaggcatgccatatcgacgtaagtcaaaccagcgttggccttcgtaacaaagttcttttctgcgttcttcacgtatcttggtaataagatcatctccactcaatcccgaaaaggatggtatgtttccttcgtcatatcgtttttccagtagtgcgttcatagtggtgatagcttctccttctgcttgactcatggcagcagcttcagcataattcagataagcttctgctacccggaaagagagtgcgaaataatcactgcttccggaagtggggacagaacggagcgtcttatatttgccatagggaagatacgtattataaaatgtactgctctctgggacatcttcattatactgtatctcccgagtaatataacgatctttgcgtaagtcaccttccgagaaactgttaatcaactcatctgctgctttgaattttcttctggtatcgttattattcttaccttccttttcaatataaccttcgtattcacctgtcaaatctcttatggttccataactccagataacttctggagaatcataggtgttgaatgtataataaggttctttcatacccgcttccggtgcagggattgtattcagatcgcgcagtgaaaagttccaatctttgataactttttctgcatacgtttttgcctctttccaattttccatatagagagccacacgtgattttaataattgcaccataggtaggctaacgaggtagtttggctcatattgttgtgcggcggagagagtcaagaataaacgttctgcttcgtttaggtcggcaacaatctgtagatatacttcctctaccgtatttcgtttcatcagtacctcaccttcatctctcattttactgtcaatttttagaggaactcccaatgattctttgtcgtaattatatggaagtccgtattgattaaccagcatataatagaagaaagccctcaaagcataggattgtgccttgatgtaatttttttcagcttctgtaccggacacttcgtcagtataatcaagtgcagcattggctcctaaaatatattcataaaggtttccccatgtattgctcggctcttgtcctaatttttgttgcatttcgaacatattgggttgccaactgtacagtacctcgaatgtttccatttttccctgttcattttcagggaattcgtaaccctccacttgattttgatcgatatcatctgcaagtatttccaaataggctagaaatttggtattcccttgttggggataagcctctccaataagcatctcctgtaatgcattggcatccttggggatgtatttgctttgtgacttgggctctaagaaatcactgcaggcagtgagacttgtcaatgtaattgtatagattaaatatttaagtttcatatctttctttgtttatagtttaaaatccgatattaagtcccagtgagaaagatcgtggcatgatactgttttctaattccgggtcgaagccattgaaacgtttgctggctattacaaatatgttatccatattaaaattgatagctaggttttttgcatggatcttgtcacaccattcttttttcatttgccatgataatccgatgttacgacaacgtaggaatgaaccactgactaccatagcatctgatttctcccacatttcaatagctgattctgcactatctgtattaggcagggtccaccctatttctatcggccatgtcggaagtccgggaatatttgtgtagacctcatctccgggcttttgccaacggtttagtaaatcgcggtttacatttttggttggatccggcatcatactgccgcttccttgaaaatcactgtaaggtgacggcaagcgttttttactacctaataaaagggagaaactggtatttaatgacaaagatttgtaacggaaactaaaaccgagacctccggtgaagtacggctctgtttctccggaatataccaagtaagtagtcggatcgatacttttgctcttttcttcatctgggacctcaacgtagttgaacattggtttaccattacttccgtcaagaccagcaaaagagtatgaccagaatgcactcagcggataaccttcttttaatatctgtgtactacctcctctcaagtacattgctgtgtttctgtcaattttggtttctccacctttgttccagtttttagaggcattcaggttgatgttcaggctgaaatcgcgcttttggataggcgtgaatgataatgtgtattcaattccccgattgtaaataattccaccgttacgtttcatatcatcaattccgtattcgaatggcaaatctacggtgattaccgcattggaacgtctggtataatattccagattcatatagaacatacggaacagttccagatccacgccgaagttccagtttctggtacgttcccaggagagatatggattaggtatctggccgatagtggagaagtagcgattatatccgggttgtactccctgttggcttaagattagttcaggactttctcgtgttaaagcatttccctgaataccgaatgttcctctgaaattaagtgtagtgatccatttcaaatgtttttgaaagaaagcctcttctgatgctctccaggagagaccgaatgaataagtcgggtcgatacgatggtttatatcctgcccgaaaacgttggaggcatcatttcgtacattggcattgactacatagcgattcttgaatgaatatgcgaaagtagcgaagaatgaaaggaagttgttggtattgtctgttctttgccagcctctactataaatatctcctaatattccccagcctgttggaggattgttgggagttatcacttcacttggtatggtaggagcaacaatacgttcacctctgtccggcacatatccccaaactttattggctgttcctttcgctgtagatgaacggagttccatacccaataatgcgttcaatcggttatcaggattgaatgctttactgaattgtaacttgttctgaatattgtaggaatactggttgttgtcgtttgtatacaatatacctccgaatggaagctgcgcagctttaaattcagcactggtgggagtaacggaattaaaatcgtagccgcgatactcgttggcaatatagtaagtacgttcggtagcccagctttcattcgtactattgttattcgaataacctccggtgaattggtaggttacccaatcaagaatacgccagtttacatctagtgaggcggacatgaagttcgaacgtgcttttgaaccgctgttgtcccgttcattgataaaattgtatgaaagggtttgtatcttaccagttttagagttgtagccgttcctttgcatataataagcgtccggatcgatgatgcggttggtgttagtagcataactcattgggttgacttcgttgaaaaagccatttgtggtagaaacactaccgtttaaagtcagattgatagttagcttttctatagggcgtaacatcagggcgatacggcctgtcatacgttcgttgtcgttgccgatttcctggccttcactgttattatatcctatggatgctgaataactgaacttgtttgttccgccggaaacactaacgttgtgagtatggctgaacgaacgacgtgtcaggcgtttgaaccagtctgtattacgggtttccatatcgttataaagctttctgtattcgatgtctgaaatatcatgttcctgcagcatccgtaatataccttcataggtgttaagatccttataaggtgtttctatataattaacccctgcatcaaacgcttcttgtgagaaacggacacgttcttgagagttcatgaagttgaacatcccataattaggacgttgtccgatgttaaagttggcggagtagtttacggttagtcggtcagtagtatttttcttggtggtgatttcgattacaccgttagaggctttcgaaccatagatggcagtggcggaagcatctttcaagatggtgatattttcgatatcggcgggatttaaccacgaaatctggttaccgataatgtcttgcaaatttttagtcatcaggtcgccactgtctaatgttacctgaaaatcttcctggataatgccgtctactacccacaatgggtcacggtttccttgcaacgtactggtacctcgaatctgaatcttgggggcagtacctacacgactgcttgtattggttacaaccatacccgctacacgtccttgtaacatttggtcaatagtagtaaacgaaggcatgatgatatcttttgctttgatgctggtaatagatccaacgatgtcacgacgttgaatattctggtatccggttaccaccacctcatctatttctgtgctggtggagctgttcagagtgacattaatggtttttttacccgtatattttaccgttttcttttccattccgataaaagagtacgtaagaatcaacccttcctgtgctggaatattaaacgtgtactgcccgtccaatcctgcaatggctccatgtttagaacctcggatcgtgatagtagcgccgggcaaggcctcaccgttagtatcccggacccaaccgctgatggttatcttttggctttgtcttttctttataacaattgcgctaccagagatttcgtaagtcaggttagtgccttccagacattcatccagaatttcagtaatcgttttgtctttggctctgatggtgatatcagttacattagcgacatcttccgttccatacataaagacaaatttcgtacgattctgcagataccagagcgctgcttccagcgtttctcctctcaagtcgatggagattctctgattgtcctgtgcttgaatcatgagtgaagaaagggagaatatccataaaagacagaacttcacaaagtttctgcttgcataagataccacccatggcagggattttactcgttttttcataatgcgttagttatattatgtattattactgtttgtaggaaatgtgcaggatgccctcccgttgtttgatattgaccagatttaattctgtaatcatgtcgataatcgggttcatgttggcgtagcggttaaggtaagctccgatacgcacctgtttggctgcttcgtcttcaaaagaatattggaatccataccatttggacaggtatgacatcacattctcaagagggacatttaaaaagataaatgatccggattcccaagatgtatacaaatcagtgtttacgttggcgacggtatttgtaccggtatttttattatatgtatagtgctggttgggaactaattcgaattcttcatttccactgttgattcttactgttccactgattaaggttgtactttccgtatcttcatcagcgtaggctcttacgttgaacgacgttcccgttacccggatagatgtatgcgatgtttttacgataaacggatgctccttgtccggggcaacatcaaaataagcctccccttcaatttgcacaatacgttctttgctgctgaaacaaaccggataagtcagccgggtttccgcattgagatgtaccctcgtgccgtcggaaagcgtgataagacattccatcccctgcaatgtgcgtagtgtgttttggatttcttttacttgcggtttgttggcgggaatctgatagttgatccctttagaatcgatcacaaatgctctgactgcattctcaggaagattattgtcggaaagattgaaagatttgccgtcactcaagatcagttccccaccaagggttcccggagtgatgtcgctaatcgtttcttcggatatccaatgatagataaagtaagaagcaggtactaataacaataagatgagagctgcatatttcagactctttttccacgaaaaaacagtacccgattgattgcctcctaataacggatagactttctcccacgctttttgtgaagagaagctttttattaaccggctgttttcttcatacgtttccttatttaatatccggtcggctatcttttgatgttccgggttttcatccaaccatgcacgatagttcttttcctcttcgggggtagacgaatgagtgaatagagaagctaagatttttgcaattttaaatttttctttaaatgaattcatcgttttttcgatttgttatataagtaaaacaatccaatcgaaaaaacggggtaatcaaaaagttactttatttgcataaaaatagtaataaggtgtaatttatgcctttgagactttcgcgaagtttgcgataggcgaatttctttaacgtatggacagtgccttctgaaatttgcaatttgtcagcaatctcatggttttttaaccctttcatagaatataagatgatatttcgcatttgggtaggcaattcttctaccgctttgcgaaccatgtggaatgtttcctgttcgataatggcagcttcgaagccactatcgaactcttcctgtccagaaaaatagggaatatctaattgctcatgttttaagtgattcagacatttatttcgggtgacggtataaaggaagctttttactttcaaaatgtcgtcaaaatcttctttccgttcccaataagctaacaatacatcttgtgcgatgtctttgcaaacttctttgtcttcaatatagtgggatgcgaacacgcaaagaataggatagtagtcatcaaatagctttttgaaagcctgtttgttgccacgttttatgtctgcaattatattttctatatgtatgttcactatttagggtggaacgattggtgcagaaactctcttacccaatcttgcttattttcttcagcttttcttcttcgatgattttgatttttcttccgtcgatagtaatcagtctttccgtagcgaattgcgacaaggtacggatagcgttcgaagtagtcatattggaaagatttgccagatcttcacgtgaaagataaatgctcaacgtagaaccgtcttcttccagtccataactttctttcaggaagatgagtgattcggccaaacgtccgcgaatatgtttttgtgtcagattaacggtacgttcgtcagagatacccaagtcaatggaaagttggcggataaagaacatggccaagtcattattttgggcaaccagcgtagtgatggcactcataggaatcaggcaaacaacggaaggttcgaaagctgctgcggcagttacaaaatcttgtttggcaaaataagcacgatatgcaaagtattcgcgtggtttaatcatgcggataatttgacttctaccccccacaccatctttgaagattttcacttttccactgatgagacacatcagatgatgtggcgtttctccttcacagtagatggtttcattctttttgtaggtttgtatcgtataattattcatcagaaactccttttgctcattgtttagaggagctaacatatcggataatggttccgaaatatcgatgtctgacatattcatttttaccatgagtgctacaaaactgtgttatacagcacaaaagtaaaaagaaaaaatgagaaaatgaacgaatctataaaaagattgcacaaaagtgggagctttcgtgcaatcttgcagacattttatttggtaaacaacagttctctatatttaggcaacggccatatttcgtcatccacttccatctccaggtggtcgatgtggtcgcggatttggtcaagatacgggcgtactttttcttcgtatgcgaatgccctttctttgtagttttccatgtggttggctacttttcttgcttcggtcatgtcgcgcacgagtactttgatagaagtgacccggtgtgaaatctcacgaatcagttctttacggtcggcacttaatacttcatattcttcagccgggaatatttctttcagtccgcgaagattttcgagcaaacggttctgataggcaacggcagttggtacgatgtgattgatggcgaggtcgcccaatacacggccttcgatttgcaccttcatggtgtatttctccagttccacttccagacggctgttcaattcggtctcgttgaagatacgttcgccgataagtactgatttggattggttatcaatatagtgcatcagggcttccggtacgtggcagatattagtcagtccgcggcgtgcagcttcttgtttccattcttcggaataaccgtccccttcgaaacgaatcggttcggaggcgataattgtttctttcagcaggcggaagatagcttcgtctttgccaactccttcttccatcagcttttctaccgatgcccggaattcgttcagctggtttgccatggccgcattgattgcaatcatagaggcagcacagttggaagaagaacctgcggcgcggaattcgaaacggtttccggtgaatgcgaaaggagaagtacggttgcggtcggtggtatccagtaaaatttcggggatacgtccgatgcctaacttcagtgtggttttttcttccggcgtcattttctcatttcctacctggcggacaatttcgtcgagagtagacgagagttgtgaacccagaaagcaagagaggatggcgggaggagcttcattggctcccaaacgatagctgttgctggcgctcatgatggaggcacgcaataaatcctggtttttataaaccatcattaaggcgtttaccagaaatgtgaggaatagcatattgcctttcggattctttccgggagcgaacagattgataccggtatctgtgcagagtgaccagttgttgtgcttgcccgaaccgtttactccgctatatggcttttcgtgcaggagtacattaaaatgatgcttcctggcgatacgcttcatcaaatccatgacgagctggttgtgatcgttggcaaggttacagttttcgaaaataggggccaactcaaattggttgggagctacttcgttatgacgggttttggcaggaataccgagtttgtgacactcgatttcgagttctttcataaatgcagtgacacgtggagggatagagccgaaataatgatcctccaactgttggtccttagcagaagagtggcccatcagtgtccgtcctgtcaggcagaggtcggggcgtgcattatataaggaggagtctacaaggaaatattcctgttcccatcctaaattggtatatacgcgtgtgatgttcttgtcgaatagctgacagacttccgttgctgctttatctacagcggcaagtgctttcaacaatggagttttgtaatccaatgcttcacctgtataagaaatgaagatagtggggatacaaagagtggtatctactacgaatgccggtgaagaaacatcccaggctgtgtatccgcgtgcttcgaaagtgttgcggataccgccgttagggaaagaagaagcatccggctcttgctggatcagtagttttccggagaagcgttcaatcactccgccatcttcaccgaattcgataaagccgtcatgcttttcggctgttccgtctgtcagaggctggaaccagtgtgtgtagtgagtgacgttgagtgacttagcccaacttttcataccgttagcaattaaatctgctatttcacggctgataggcgtacctttttcgatagcgtcggttacagctttgtaagcttctttgggaagatactcctgcatcttcttgcggtcgaacacgtggctaccataataatcagagagtttgttggaaggggcaataacttccagaggtttccggttggaaagctcttgtaaggcaaaaaaacgcatttttgacataaatggtctatttttttatcggttgatggcgcaaaattatatgttttttctgaaagtacccctattttagagggggtattttgaaaaataatgtgtttttctaaaagtaccccctctgttgattctccaacttctattcttattgttgctgttcgttgatttctttagccatctgtttaaccaaactttccacttggatataatggttgtgatagttcttgaataacagtttgaacactgggctgctcacagccatttgggtgagaaattgtaggtgtttacccgtagaggtgttcatctgcatacgtttttctttgctcaagttgtcttgtatggaataagcaccgcatgaaatttggatttctgcaatgccttcatcccaaggatgggtgttgaggtgagtcaatgctgccaggattttttttaggtttttcagcagaatgtttaatagttcgaattcggtacggtttacggagcaagaatccgggtccagaaggaaagcgaatttaaggtagaaatcctttaattcttctttaggaataacaaatgaatctttggaagcctttatcatgcctcccaccgctggttgaacggtaacttgttttgtttccataatataattatgaataaggtggtaggcgaagattttctataaaataagagcggttccgcctttcccgttactcttcaccaaccaggcagtgggtgcattaacactccacacgggggtacgaaaccgccatatgaagcatcaggacaggcataaaaatgcctgccacgaaacgaggcaggttccctgcctggttgatatgaagagtatcacaaagatacgacaattttcttctttgtcaagaataaaaggaaaaattaaaggtaggagtaagcatctttctttttcatttagtatatactaataccttatattaaccgatattggaattttctattttttatgcggaaatacattagacttgtatttgtttagtttctatttgtatggaaatgaatgaaacagtgcgaaaatgagtgaaactgtatggattcggtcatacacaatagaaaaaacatctatcatactatcattcattttaataatattctaattatcaaaagaataagtatgatagatagctctaaaaaaatgtatctatcatacttttattagtaaaaagggacatctatcattcctatactgtatctattttagtgtagcattaggtgagataatctggtgtaagataaatgtataaaagattaaggaaagagtataatgcgttttccctgtaaagtaccggtatcattaatttcccacggccgtgacaagatcttcccacggccgtggtaggaactcgtcacggctgtgggaagaagctaccacggccgtgaagaattaagtataccggtatcctgatcgaacaatagttattgaatgatataagtatgctggttgtatgacggatgtttaatggcggcttttcttgaaaggtaagtaaagctggaaggataggagatatgggagagcaaaatcataaaataataggctgacaataaaacttataaaatgttattgtcagcctattgtcagggcttattgtcagcatctaaagggttgaaaatcatttatctaatgaataggaatgacggctgacaataagaactgcaaaatttatatgtaaatacaatcagtgatgtagttattaactcatctttgcattgattggattgagcttttttatctactttctctcttacttttcgattcgttcataaacagataagatttcttatagcctccgtagtctacgactaacttttccagcacgatacccggatcaagaggtttgaaagtgattgtttgcataccgtctgatgtattcggtacattcagttttgcttttttctcaacgatgcgtcgtgcgactgtcggatagtatatgctgtatacattttcaggaagctcgtttaagttatgattgaaattgatcgtctgatcctttcctccttcaaatccgatactatactcatgtcctttgcgatcgtggaaagcaagagttgattttactatcacatggacagtcaccttgtcaattcctttaggcaactttatcttgtaggagatagaagctccgtcagttggttgtgtgtaaggcatcagagccatgccactaagggtacgccccatatagggaatcactgtccattccgtatcaggcgctgctttagcgctgtagtaatgttcggcttctatggctatatatccgtcttgtccggtgaatacgtatccgccgacagccttttccggattttcgattcggtagattttaggcagtgtatcagcggggaagttatcattccatgaggtataaccgatatgtttctgaatcatcatattcttccatttgccgccggacataatgttgttataatcgtcactcaacgctttatcccgtgcaaaagcctgttccactttatctgcccattcgttagcttgcggattgttttctttatacaatttatggttcatggcttgtgcataatacatttcgtacaggtttgccatggcttgaacggggaagaggattaattgcttgtaggcatctttatattccggtttcagtgatatgtattgtctcaaagcttccgcttccagtttcagatattcatcagatacttgtttccattcgccggtctccaggttataagtattccggtcgagcatttctcccgtcacgcggccgttgtatttgctgtacaggtttaagattcgcatggcttcatccgcctggtcttcgccaaactgctgtgcgcagaaacgacggggatgatccagcaagttggagacgttgaattgcttgggattccatgccatatccatgaagagcgtgatcggatattccattggtttcaaatcgcctacattcagtatccacagcttttctactccataatcgtatgtgagttgaagttgctcccacatattttgtataggggttacgttcagccatttagagtttctcggagcacctacgtagtctacatggtaatacatgccccaaccgcccggatgcttgcgttctttggcatttggcaggcggcatacattgccccaattatcatcacacaatagcatgataacatcatcgggcacacgcatacctttatcgtaataatccaatacttctttatacaacgcccatacttgcggagtctctttggccggacgtttggtgacttcttcaataatcttgcgctgattcttgactacattctccagaagtttcacattggtgcttttactcatggctgcgtcaccgtctccgcgcataccgatggttacgatatcttctgtaccctgcatccgttcgatgccttcacggaaaaactgatcgatcactttttggttagttgtataatcccatgcaccatattctttgcgcttgcgtgaccattcctgatggttgcgtgccatcggttcgtggtgggacgtgccgataatgactcccatttcacttgctgttttactattctgcgggtcgtcagcatagaaagcccagctccacatggccggccaaaggaaattacctttcaggcgtagtatcagttcacacacccgtgcataaaaacgatggtcgccgtagttggtgccgtatgtgtgttttacccatcgggtaagacacggcgcttcatcattcagaaagataccgcgataggttacggccggctctccgtccgagtattgtccgggtttaatatatacatttgcttgtttcatgacgggaacatctgcccaccaataccagggagatactcccatctgttcagaaagctcgtagataccataaatagtgccgcgtctgtcgctgccgatgataactaccgcttcatctattccctcgcaaggattggcgatgacttgcaggatgtatttttcattttttccatccaattcctttttgtctattttgcctgctgacatcagcttctttataaaaggagtgccataagtacctgcaatgatacaccgtttcgaacttgtgcttgttaagagttcgggcttttttccgcatacttgcagtatgtcttgttgaagattgccggcagcaatcattacccctttgtcttcggaagaatctatgtatatcggacaaggaactccgttggcaaccaacggaaaatgattaccggccggtgtgaatattacaaattgttcagcggcaaatgccgctatactcacaacagagaggtagaagaatagaaataactttttcatggtttcaatatttagtaatttgttgttaatcattgatcttatgtttcacagtaaccggatattctatttgttgataattgctaattggaaactggatgcaggaagtccttctgtattatagatggaagagggtggattgttttcccatgcatagcggatgcttgccggtattccttttccgttccataaagcaattactttatccccttcggtataggcctctacaaatttatattttccatcattggcagcaatggcaatgccttctaatgatttagcttgctttaaagagcctgttccttgcctgaaagagataacgatccgaccgttttcttttaattcggcagcttcagccataggcccttccgctacgatattcttctcaccgaaagaaagtttattcatttgaagcacacaacggtgtgccaagtcttttttgttaagtggatgaatatcattactttcacctagatcaatggcagtggccagtccgacattctttaactggagacttgccttgcgttgtgcttcacgtacttgtgcgttgccactttctacaggcactttgcttctttgttggtaattcgcaagttgcacaatgacgaaaggcaggtttttattgttccattgggtacgccagtcgtttacaagatcaatcagatgtctttcataatgtttgctaccttcaggacccgtatccgactctccctgataccagattatgcctcgtattccgtagttgcgtagcggatgaatcatactattatatagtccggtgggttcattttggaatccgatagtggaaggaatacgcttcattgtacagcctattttatgctgccacatagcggtcagcggaattgtctgaccggctatttccaattggtaaggcttcccttttacaaattccggacgtccggcactgctgacaaggcggatgacaatctcgttttcaccggcacggagtaagtctgtcgggacttggtaaatacgcggaggatattgataacttgttcttcctacacagataccgtttatataggtagcatccgagtcttttagtgttcccacgcgtaaaacagcttgttgtccggctaatgattcgggtatgttaattcgctggcggaagtaatggactccattaagaggagtgttccagctacctccccaattggagttgaatacatccacttttttccaatctgaagcgtcgaaaccgtcacttgtccatttttctttgttcccaaggtcatttgccgattgctgtcgatgccattgattcacttgttctttttgggcgttcttcacagaatccggataatcaggatggaagtactgtggggactggagcttttcccggaatctggcatatttctcgagtgactggcgggtagaccatgatgctatgtttgtccctccccagctactattgataatgccaattgcaactcctttttctgcctgcatttcttttgcaaagaaataacagagggctgcgaagtccaacgtattctcccgggtacagattttccattcattattgctatcttgttgaggctcgataaagttgtaagcgtacgacgttttggtataacggatcagattgttttcatacgacatgatttcatccctgtatttatccatgacacgctttacggtaagttccatattcgattgtccgctgcatagatacacgtcgcctacgtatacatcttgtattattttctggttgactctcaattcgtagggacctccggccttgtgcttctgcaggttgaccgcccattctcctgtttgggaagcccgggttttgtattgctttccgttgaattcaataacaacagtttctttaggatctgcaaaaccccataatgggataggggtgtcacgttgtaaaaccatcttgtcggaaaagattccgggaagtcttacttctgcctgcattcctattgtatataacagcaggctcaaaatgatgcaaatgttcttcttcataaatattatatttagcgagattatcttctttgtgtctcaaattccaggaatggtttatttttcgtctgtactgtgacacgatgcaaagatagttggtattgataagaacgggctttgggtatgtttcaattatttattctgttgataccaatctactatttcttgaagtttttttctttggggataaaatgaagaagtgtgaacaaaccggtttgttcaataaatgtttttgattttgtttcaaaatctttttgtattgtatctatgagactgtcggatgaataataatggttaatgtgtcatattccgtattaataagattggtatatgatgcgtataataaactcttgattaaacaagagtaagtagagattttaatgatcttgagaatatcggtaagcgtcgatcgcttgttttacagaaccgtgtaacagcaacaatttttgtgcatgatcatgatctaatcccagttcctccataatcatcctggttcctctttctaccagtttatgattactaagttgcatgtttaccatcttatttccttttacccgtccgagttgaatcatcaccgacgtgctaatcatgttcagaatcattttctgtccggtgcctgatttcattctcgaacttcctgtgacatattccggaccgacaatcatttcgatggcgacatctgcttctgccgccatcggagaattcggattgctggtgatgcaacctgtcaggatgccatgcttgcgggcctcccgtaaggcaccgattacataaggagtagtgcccgaagcggcaatgccaatcactgtatctttttgattgatatgatatttcgtaagctcttcccatcctcggctcatatcgtcctcggcaccttctaccggattgcgcagggccgtatccccaccggctatcaatccgataatccaggtagggggcattccgaaagtaggagggatttcggaagcgtccagcactcccaagcgcccactggtacctgcacccatgtaaaagatacgtccaccctgtttcatgcggggtacaatttggttgacgagctgttcgatttgtggaatggctttttgtacggctaacgctaccttctggtcttcccggttaatgtcttctaatatttcccgtacggatttcttttccagattgtcgtagagcgacggttgttcggttatctgcatattgataatggcaattgactaaaaatacaaattacaaggattgagatgaagcggtatgatataaaattagcccctccatcggactttgcagaatctttccgattctgattcctgtctcttgtgcagcttcttgtaatatctccctgtagcagtgagccactgatccgataaaatgtacagggtactgcgtgtaatcatattgcattacatttcttcggaagaaagcaataaaactatcaagcactaattgtcgtatccccggctcttccagatgttgcgctataaagggggagagacttgccagaaaacgattcgggaagggttggcgatacacccggtcgatgatttcgggagccgtcaggtcgaactgttttaagaaagcttctttgatggcgggtggaagctggttcttcaggatgtctcctaccagtaatttgccaaggacagctccacttccctcgtcgcccaagataaagcctaaaggggagatgttgttgacaatctcttcgccgttgtagaaacaagaattggaacctgtgccgaggatgcaggcaatcccagcttcatgtccgcatagtccgcgggcagcggcaagcatatccgagttagttttgatatttccgatcacgggcaggctgtcggcaatggcccgtcggagaacgggagctctttcgggagtgcatcctgcaccataaaaaaagacggagttgatcgttccttccggtagttgtggcaaaagggaatgtgtcagctcttgttgaatctcttcttctgattggaagaagggattgattcctttcgttccaattcgtttgattggggtgtcgttgaaaacgatgcaccagtcggttttggtagaaccactatctgcaatgagtatcatatcttaatgtatattttctttttgtataatatatagcctattgaccagttaagtaagacaaagaggatagcataggcaagagaacctccttcatccccgaaaacaggttggagggcacatctgtagacgacttgttggatggggacactttctccctgataagtgacggtgatagcgcctaccaaaacggcgatgacacctgccattacataaataaagagaggattcactccgaaagattcaaagaaacggctccattttttacatcctttgatatcgataatccagacgagtaaagctaataggctggagcctaatccgcaagtgaccagcacaaaggtgggcgaccatatctttttgttgaatgggcaaccatagctaaataggaaacctgcaaaagtcaggatagtaccgataaggaaaagccgttccaatttttcatgtatatcttttacttccatgagtagtttgccgacgcaaaatccgatcaatacgtgtgcgatagaaggaatagtgctaagaagtccttccgggtcaatgtggttgtcttgatacatatgagcgtctcccaagatgctgcggtcgacgatggaaagaatattcgtttcgttgtaggcaaaaccattaccggtaatgagaataatgaaataacctactaataataccacaatcagataaggtatatacttgtgtttcaatagcaaggcaataagtgctgaagcaccatagcagagcgcaagacgctgcatgactcccaagatgcgaatttgctcaaatgggagaggattgtgggtgtaacacagtaaggcaaaccagttgagggctattccgataaggaaaataacaatggttcttttgattattttcagggcagccggagtactgaatgtaaagttatactttttaagtgagatgtaggtggagattcccatgataaacatgaagaaagggaaaactaggtctgtgggggtaagaccgttccattgggcatgttttaggggagcgtatgcatgtccccaagagcccggattattaaccagaatcattcctgcgatagtaatgcctcgcattacatcgagtgccaaaaggcgtttgttacttgttgtattcatgactgtcactttttaatgtgttaagttaataagtaagtttattgtttctttccgaaagaatcttccagtcggttgcggatcattaatgaggcgacgataccgggtagggtacaaatacaaacccaaataaagaagttggtgtatccaagatgctcctgtatccatcctgcaggcatccccggaagcatcataccaagtgccataaacccggttccgatagcatagtgcgccgttttgtgttcgccttccgcaatataaatcagatatagcatataagcggtaaagccgaaaccatagcccagttgttcgatagctacgcaaatggctataaatataggattatccggagtggcggcagccatccatacatataatagatcaggaaggttgatagctaacgccataggtaatatccattttctgaatccgtcgcgggaaacgaggaaaccactgatgattccgccaactaataaagctatgacgcctatagttccatagatcattccgacagttgcggtagataaagctagcccacctttatcggtagcatcgagcaggaaaggagaagctattttggctaactgtgattctcccaaccggtaagtgagaaggaaaaagaacatgagacccaggttctttttcttgaagaaggtgacaaaggtcagaagaaaatctcccaacaatttacccggtgtgagtccgggacgtttaatgtccgaatcaggatgggggagaatcagacgatgatagatagtaagagcaagaaacaatcctgcaagaaggtagaatgtaatactccatgccaagggaatattgttttgtgatgtttccaaccatcctgccagcatgacaagaattccctgcccgaaaatgttggcaagccgatagaaggtattccggataccgacaaagaaagattgttccttattattgagtccgagcatgtagaaaccatctgcagcgatgtcatgtgtagcggagctgaaggctagcaaccagaaaaaagcaagagtcaactgtacataatgtgcagttgggataaagaaggctatccctgcaaatccggcggcgatgaacccttgcatggcaataatccaagcccgttttgttttcaccagatcgacgaatggactccatagaggtttgatagtccagggaagatagagccaggaagtgtataaggctatttccgtattggataatcccaaacgcttgtacatgataacagcaatcgtcattaccgctacatagggcagcccttctgcgaagtagagggttggtatccagctccagggatttctttttatagtgggtgttgtcatggcattgttctttttttcattgatattgtttttcgagcgtactgccggggtaatagtgagacagtatttcttcatacttataaccttgctctcccattacggcagcaccaatctgacaaagtcctactccatgtccccatccggctccggtaaggatgaatcgtgaaggaattttatcttttttatgtcccttttcttcatattccttgtctattacgaaggcggaactataaagatgggaagtagatagggtacgacgtatttccagctcttttccgataataagtgtccgcaaggttcctacaatcttcaatcggacaaggcgtcccgacgttccccgttctataggaattaagtccagaatttgcccgaaatcaatccccgaacgttgatgaatcagggttgaaagttcttgttgggagtagcagactttccaacgatagaagtctgtcgtttcctggtcatagttgtttaaaacctggcttagaatctttttgtcctgcgtgtggcagaatgcgacaggagaagtacgaatccatttatcagcctccgtctctattgtcaaatcgggtagttggtcttcgatcttacaatcccgttgaccgatgagataggggtgctttacgttttcccaacaattctggaactcttcaaaagccccgccgcaacatttagagaaacgggcatcacaaatcgttcctgcatacatcaatacttcgccccgggtagcagtgactgcttcgatagcttgtggtgttgaggcacgtgtgattccttgataccgttggcagtgatcgtctgcgcatacgtcaaagtttttgtgcgcttcgtggtcataccatttgataaattgagaatccgaaacgaaagatggagaacaggttgcgctatccttctgtatagactttcctgttttctcgttcttcatttcctgttttctactctctgtcttacacttattcaacagccaacttcgggaaataacagcatgtgcctttagtagttctaaagaagcagtagcactcatttctgatgaaatcacactgatgagatattcttcgatggaaataatattgatagcagtaagttgttccccttcgacgatgatctttaactcccctttgaatttctggacttctttgcgttcccaatggaagttgattccgatggtcacatctttcagttcaaagaaagcaggtgcaccttgttggggagtgaaagataattcattatattctttcccttgccaatgaatcttcccatcccggtaaatagccttttgcataccggagctttccgttccgtcggaggagataaattttatagggaaagaaaattcaatctctttcccggaaagaataccaacacttattaaggggactcgcatattactttattactatttctttttgaataattgatcgcatagagtatttaattgttggggagataaacttatctccttgtaaatctctgtgagttttttggcgtttaatttatccatgtcttcttctctgacaatcgggaatatgccacccatttctgcaacagccggacttattaatagccctttttcttttggggtataatagcaatcgggacgatgttttgagcgtaggaaaatgatgcaattccatacttctatttcgtcacctccgaaatggcttattttatcgagaccataccaggttatcatgttgattaaaggttccttatccgaataaatgatggaaagattttggtagaccttttcaaattgttgcattaagtcaactttcagacctgatgtcatacctatgcaagttgtgaatacattgtctacataagttgttacgccgttttcattttctaatatactcttcaagaaattcagcgcaaaagggttagtcagttcttcttcttttcctgctgcctggaaatgcatgtggtcaggggcggaagcaccgcactccggtccgttatagagtatatagaactcgtccaggttttcagctaagtgaagcatatcttcaaaacgtcctttcatgctttgtggagtgtgttccttgtcgatgattgtcaagtgacgctgaaaaatggggtaggggttgaggcatacctcataatgtccgaatgctagatatgtttgctctgcggggcggtttttcccgcataagaaacaaggcctttcctggatagaacgactatctgtttttgccatggtcgagaggatgcgttgaggattcgggaaaattctaactttcatctctctatcttcttccttcagtttcaagacttttttcttttccagattttcttccaacgcttcatagttccttttcgcaagttcccagttttctttttggttttctatcatttcctctacaagttcttgaaactcttcatcgatagtatgcatctggattctgcccttaatttcccatgtgcggattcggtctttgtagaagttgttccgattgactttttctgtgcttaatgcggcgtcagagttaccttcccaacggcgacagaggtatattacatcatagatacgtccgatcttatactcccgtgagattcgtaatcctatggcgtaatcttcaccatagctggtattcggcaatttgatatcacgaagaataggagtgtagaaagctcgtggagcacccaaaccattgatacgtagagcgttgttctttccattttccggtgtccactctttgtggtcaatgataccgggggggatttcgttcagttggaagtcggtcattagataggtacctataaccattgcgcagctttccttataaaaggtgtctacgattttctgtaaagtggattcatctttatataaatcgtcgctatctaactgtatagcgaactttccgcatttttcgtgacatatacccttgttccagcaccctcctatacctaaatcattttcttgggggatgatatggatcaatcttttatcgctacttagttcctggagaatttccgtcgttccatcggtggaatgattgtcgataacaataatgttaaaagagaaagtggtccgttggtttaaagccgaattgacagcatcgcggattgtatgagcacgattgcgtacagggatgatgacagatgcctcgaattcaaagttttcgctgtgaagatttacaggccgtgaagaagtaggcatgaaataagcatcaatacatttcaggtattcggtgcaggcagcttccatttcaatttgtacttcccgatttttggggtttacatagtcgaattgtttctctccgctttttctggtatctgtttcaatttcgatgtatagatattcattgatgtgcacaattgaatatttgtaagagatgaatagacgcatagcatatagtcctgcgtatttgtactcttcacgcaaagcatctgctattttagtgaaggcagaagaactgaatagaagcatggaaccgaaatcgaaatcatcccggacgcttcctaattggtagtcaatgacaggtgcttgtttaagttctccgttaatcagctgatagtggtcggcataaactattccattctttttatcgttctccatgatttgcaccatgcgttccaaggcatacagtcccagttttaatggagtttgtttcaagtagaacagagtatattccgtattggcattggctgcaattgttttcattgtgtctgtggaatagaaccctttaacagagagatattcacaacccggaagagctttcttaccgggctccgaacctaataaatagatcttatttactagctctgacacttgtagttcctttactgtctgcatggtatcttccggggtgccgaaaggtatgaagcaattaattttcttcttcatcttcatcttaatattaaagaactgtcgtattgtccatcgttgatttctttcgaatgaggaagcaaagcccgatgaaagtaaatgcagcgttaaataatagcagctcgtaactaatttggtaaccgttgaaccatgcttccgaatttcgttgcaggatatagcaaagaataggagaagcgatagctaccaacggaatatatttatcataaacttgtttcttggtgaagatgccgaaagcgaacaaccctaagataggaccatacgtataactggccaatgtgtaaatcgcatcaatcacactggtgttgttcagcaaattgaatacaaaaatgactgcccccatcacaactgccataccgatatgtacctgtttgcgtatcttgctaagtgccgcctctccttttatctgtgcatgtaaaatatctacagtaaaagaagtggtcagtgccgtcaaggcagaacccgctgcagaataggcggaggctatcagtccgataatgaataatattccgactatgccgggaaaataatttccggtagcgatcatcggaaacaactcgtcgctttttcccggattctcaatgccttgctgtgctgtgaacgtatatagcagtactcccagcatcagaaaaagcagaatgacaaagaactgtgagattccactggtaatcatatttttctgcgagtcccggaagttcttgcagctaagattgcgctgcatcatatcctggtcgagcccgttcatggcaataacggtgaatacacctgccaggaattgtttgaagaaatatcgtttgtcgttgacatcgtcaaaaaagaatgtcttggaaaagtcactgtctgaaatcgtactaaccagaccgctgaaattcagatgcaggctggaagcaatataatagatgcaaagtacaaccgacactaccaggcagaatgtttttagaacatccgtccatatcaatgatttcactccaccgcggaaagtgtaaagccatacgataaataccgtaaggatcacgttcaacaggaatgggagatggaaaggatcgaagataagaaactgcaatgtcaggcatacgagaaagagccggacggctgcccctagcatctttgaaataaaaaagaaccaggctcccgtcttgtaggaagagcttccgaacctgttctccagatattcataaatggaaaccagattcatgcgataaaagaggggaacaagtacaaatgcaatgataatttgtcctactatgaatcccagcaccatctgcaggtaagaaaagctacttgcctgtaccatacccggaacggaaacgaaggtgactccggaaatggtggaaccgatcatggcaaaggcaacgatataccaggctgatttacggtttcctacaaagaatccttcattgtcggctttgcgtcctgctatataagagatagtgaacaggatgataaagtatgccacagtagtaatagatataacggctggactcatatctgctgtttaaattcgtttgaggatgaatatccggaacttgtttactttgcctacaaatgtagggaatttatcatagatatacatactcttacatattttttattccgggtgtgcctccggtggcatgtttggaggaacgccagtttttgttgagcgaggacaactccggagatttcttttcaagcgaaacgccggttattttatcaatggtgtgcatttcatctctaaaacaacaagtgtcaaaagtatgtcctggtgcagtctctttactacttgaaagtgccagatacccgccattattgttcagtgccgggaagttcggtataattattatattttctccaccgactttatgtttctgaacaactctgttgaagtatttcgtgaagcaaagatatgctttggcaggaatggttaggggagtagaaggactttcattttgaaggatggtagtattgtatattgccccgtctttatacatcttatatagataaagtgccggtaaaatgatagactgttcagtcggattgtagatttctatatattctgcaccatcagtggcattattatacatgatttcattgaaaagaagcatacctctcacatctttcggtaattcgggggtgttcggattatctggaatgtctgttccgggatgatcgggtgtttcatcaggtgtagtgtccgtttctacgttattagatagctgtatgtgatgaaatgtaaatcctttacagcgggttttggtgtaaatgcagtatataccgcagtagcgggaagtttgtatatcggtatcttttatttgtttttcttttacgtattcattctcggattcacgtcgtgtccaaaaagtccagtaaccattattgtcacgttctacttttatatatagtttcggtgaagagtctcctttcatcaactctcttcccgaagccagtagtttagattggtctccgttttgacgataaagagttacattatctttggctcctcctatctgaatataataaccgtttaaattaccggaaagaatgtttgaggaagaagtcagataaaatcgtgcataattgttagcggaaggattaaaggtgaggtgaactccaaattcccaacgggtattttttacagaggtggaaggaatggtgacataagctgttccggcgtcttcgtatggatcattcagatggattccttctttagaattgatggtgaatttgtccatctctccttcccagggaagttcggaggtaactgtatcctctccctctgaatctcctttttcttcgtcattagcagggagcgaacaattatagaacaatatgatgaagatacttaggaaagcaaatgctttgtaaactttcatacggtttttaatttgagttttttcgttttaccgtatttgtttgtgtataatgcagaagcaattgcggtctgaatatttgaatgagtcggcaaagataaactttcttgccggaaaaagcctatacttacagaagaaaagattgtaattctttttgtttcctatacacgcatgggaagaaaactgtaagggactaccctaagtcatatttaatagattgacttttgatagtcccttacaactgttacattcaatatgggaatactattcgaaacgtggtattacatatttatcagtataagatgtgaaagtaataccgggcatggaatgagtagacgatgcgttctctaattttttaatcaatgaataatcgtcggcattcaatgcgtaataattatcagaggtcggagtagtcacacgtaccgtccaatcgaacatattaccgataatggttagtgcatccgtttcgggattgaataccgggattcctgtttttacgatttcatacgtccgattctgcaacacatagaaggcgttgttgacatcggtcataaaagcaagcgtctttttgtttctgaactcgggcagatacagatgctttaacgtcagtccttcaggcaaggtgatggcacggacatacggacgccctttcacctgtttcagatgaaacagacggcggtcggcatccaatagaaggtaaccttcgtcatactcctttttcaccgtcggatttcctacaatctccgttgccgggaaacgaaaatctttcttagtcatagcttcggtaaactgaaggcttttatcttccttcacgctgttggtagccatgtcgatgaattcgatccctttggaggtgatgcggaatacatcatccggcatttttaaatccacacgtcctgacatggattccattagcgggtaaagtccgatagaaggcgcattgatatccgaaggaacgctgcggaagttgaagttttccgtctgcaccattttgggagtcactgcgattccttgaatggtatctggaaaacgctcgtcagacatcaactggcggaagtaaaacataggcaggatgctgtcgaaagcagcttccgaataaatgtttcctgccaagtcgcgacgcacgcttccctttccctcttcctgtcccatctgtgcgaaatcgccaatgacgaaactatatagggtaaagggagtcttctccggctttacgacaaagaaattgtaacaccaaggcaactgccaaagaagcaggaaagcgatggttacatataatagtatggtactgaaacgtctcatttctcaatcttttaatttttaatctttaatttttaattgtttagtcctgctttccggccttaaatcgtacgatagaaagccacgagaaagaagctgtcaacaaagtataaaccactaaataagggaggaacttgttgtatgcttccggtgtgggcgacagaaagaagatccggagtaacaatacagcgataatgagattcagaatacgacgtttccatgccggttcaaggcaaatccatgctacgagcagatagccggagatgccggcgagataccacgttaaggctgtaagcagtatgtggtttttgagctcatgggctagtattccgtttagatagatctccatcaacaggaaattggaagcgaagcagacaagaagcaatatgagtccggagagtaacatattgcctgtcattttcagttccggataaggcaggtggagagtcagcttcagacatttgcgttgcatctcggggacaaactgcacgattgccatcaggattccggcaatcagagggatatattgcaacatatcaatgaagatgacatcccgttgcagcatgacttcccatacatgggcagcccctttcatttctaccacccggttgatgcggagcatacagtagcctgtaaaaccaagtgtggcgaccacggcaagtagaaaataccaccgtgtctttatccattctttataaaatatagcgtacattcttgaggatttatgatttatgaatgatgatttatgggttacgagttgccaactcttattcttaatttaatcagtatttcccggtgaggccgataaaggcatcttccaaattgacttgctcacagtgcaagtctgtgtagggcactgacattgatttcagtttggcttctgtttctgccggttgcaggaaggagaaagtctccagctggttccgcatgatggaaggatggtagagatcatccgatgcaggaagctcgtaaccttcgggaatggtgaaggtgtagcggcgtcctttttccagtaattcggtgattggtttctgaatcagtatctttccgtagtccataataatgcagtcgtcaacgagacgttccatatcctgaatgatatgcgaggtcagaaagacggttttaccttccgaacgggcatagtcgcggagatagtccacaaacaggcggcggtagccgggatcgagtccgagcgagaagtcgtccagtaccagaagttccgggttttgtgcgaggatcagtccgagagctacttgagagcgctgtccgcaggacatacgtgagatgcgctgtccggtagctactttcaatttattcatcagttcgtagtacgcttcttttttccactggccggggtagaaggctgcgtagaatttttctatttcggtgatggtcatgaattggtattgcacatgaccttcgatgagcagtccgatattgcggcgcagagccggtgccatggtctgtatctcctgtccgaagatgcgacattctcccgaacggggtttcaggtaaccgctcaagatattgatagtggtggttttgcccgtaccgttctttcccaatagtcccaggatacgtcctttgggcactgtgaaactaaggttttcgtaaatcaaccgtttgccatagtagtgcgtcaggttgttacattcgataatttgttccatttgattttatctgttatttcgattcaaaagaagaaaaggaaaagaatgggaatcatgattccgactattagttctattcctcctctgccgataatgcccttgttccctttcagcatgatgatgccggagagagtaatgataataagggcgatagcgaaaatatccgcgaagtaagtccaccattgtcccggattgtaatgtaaacgggacatcgctccgataagcgggcgacgggtgacggattcatataccgcgtctcctgtcttcacgtttaccaggaggttggagccgcctttcaggaagactttcattacgtccgttttcgggaagtaaaatttggtatagttgccggtttctcccaaaggttccagtagagtaagtactttctctttactcattcctgctttgtccggtagcttttccgctattttatattctttccgtgtgatggagaagttcggattaatcgtgtcacggtgattcattacaattccggaaatggcatatatcaataccattccggaaaagaaaaatgacaggtcacggtgtatgagccggctccatttacgaacagtactactccacttcatacgagttggcttccataaaatagaaagataaatactcttttcctgtttctgctttgcggtcggctatttttgcgcggaagtctgcgatgcgggcttcgggactgttggctgtttcgccgcgtgctttcttttcagaatcgcatccggcttcaccggttccgtgtttttcggcagcttgtgctttgagttgtgcttcccagttctggaggtaggcttcgtcaatgcgttgttctttcagtgttccggtaacacgaacgatggagttcacgcatttaggatcgaatgctcccaaagtgcccgcttctacacggatcacttgggtatcgtcgctacccatcaggaagattttctttgcgccatgtttgcaggtatgtgtgcagacgccttcaatggtcacttcttgtcctgcaaggctttcggcattggcaagaagagaatcaatttccaaggcggaagatgcagactgttctgtagtcgcttctgatgcgcttttctgttgtttgttaccacatgaagttccgataaaagtcattgccacgatggcaattgcgattgttagcttttttgttttcattgttattgcttcgtttttatatagtttgtaatctgtttttcgtttgtttatagcttatcgtagttcgccttacgggcgaggggggtagccttacttgaaacttttagtttcccagtgtgaaactggtagtttcaaaccttgaaactgttggtttctcaccgagaaactaaaggtttcaaggcatgaaacaaatattagtcttttagttgccggcttgatcccttatgcaacgaacttgcataccggctttaaggctaacataagataatgataatctgccttccggatacttggttgcattgattgtactcattaatccaaagaactgtatattggttagtaggccgctggtactattgtatatgggcttgtaggcggtcgaagtcatgagataattcattgccggttttccatgccacgcagcttgaatcttggcgtcatctgctattgcagttttttggtagctgccggcgcctgtaagacttgttgccatacgaacaccggagaattggtaattgaatcctgcatccatcagtgatgatattttggctccatcataagctgtatcataaaaaagagctttatcaccatcagccggtaccttgccgtcggcatcattcgttgtttttcctaccagattaaagtactccagacgtgtcggtatgtgccatcctttcgggcagattccttgtgctccttcaaaggaggtcagattactatcagtaatttctttaccacccagtgcagcctggaaatcatatagataacctaattcttttatggcactttcttttgttgtagctacggttgcaccgtcggctgtgatttcatacggataccaaacatggctatcagcagttggatcacttgaaggagtataccctttcggtaaataaataagcggttcagccatccatgtcgtaccgtttgagagagttacagtcttatattttacattatcatacaggaaatagttctgatcgagatgttcctcgaaaggaatctcattatcagctccaatttcaccctcatctgtccagttttcaatgtcaccactaagtttgacttctatatcgtcaggtaacacgcgaatgttcacactgtattgtcctccttgtgccaaagtggtagatgtgagcttctgtgacaaggtcttgccgtcagatgttgctacttcaagcgtcaaggctactgtttggggaacgataatggcgcggtatgtctcattcgctttaacggcttgtgcaacaatgcttgttgcggaggcgtttgcatcagcagtcactgtgagagcactcaaatcaagagttgcagtcgggatggaacctttcaatgcgatagacgagatgttagcttctacttcctttgttacattaatcactaatttagtaaacatgtgtttgaagttcatgcttataacgttggtagtcggaagtacatccgatttctttgctgccataaaatctgacgctccatatccactagtctgatcggtttcaacagtaaatgaagccggagtattactctctttatagggataataggctactatttgcgatttgtcatttccttccgggtaccagagtaaatcgcctgcaaatactccgtcattgtatgtcatctgtttattctctgcatatacgaagtcaccgttttgggtgattgtaacaccgattttatctccggtttcaaagttaacttccgtagcacgtgtaataatgggagagatagtaatgcgactgtttgcaggagtcgtagcttcgttctcttcctgctgacaagagaccaaaagcgctgctgcgaagataaatgtcaaactctttttcattgcttaataatttagtttatttatattcattgttctcaaaaagtatatcctaatttgatagtctcgttccaacggttcgaaccatctatatattgcaggttgaaaccgtgcgtataactaccctgtacttccgcataaattccatagttgaaatgatagcgcaatccgagatgaaatgtcgcttgtggggcggttgcatattcatttttcagattgtaataatcagtcagccgataaggcggatcacccggttccgtatctgttgccgtagtcctgtttttctcggtaaagtttcctatggcaaaggatgcagccgctttcaggtcgagtttccccagatgaaatacgctggagatataagtctggctacaaatcatcttttccgaaaccacataaggatacatctgtgtggtcagtcgtctgaatgttgatatattcgttcccaggcgaagttccgtgcggggactaatcaattcatattcgggatggacggagaaaacatcctgctcaaaaatacgattggaaccgtgtacgtgagtggtcgttatcccgttcacagtttctttggttatcacattttcgttgttgaccagatgtgaccattgcaagttcagtcgcagaaaatgctctttcttttcctgtttgaaatgataactcaaatgggaggtaattcggtgggttggaaatttaaaccagatagcatctctttcaccggcagaacctgaagaatacgtgtattcagcatctccgtaaaatcctttccattgaagttgcaaggctcccccgttcgacaattctttgatggggaaaccgttgacacccgattcactaagatggattccactcccgtcccatgcctcgtaagctccatacataagtcctttatccagaaaagcattgtaagagttttcggctgtaccgatgacttctgctttcactgattcactgtttttaccgagaatataggaaaagccgatcgccatatctcccgaatgatacatgacgctgggggctattttcaaatccagtcggtaattggtatgccgcaagtcctttcgtttggaatagttggaagcggcaaagtctatctttcctcctaatcgccagttgggtgaaatatcagttgcaataccacccatgaaagtgtaagtttgcaagtctttacgtccgggtgtgaactccaggaggtctacgggataaaatcctgggtggataaacatcgaaccgctcatatccttgcctgaagtatgatcgaatgagaatgaacccgtcagtgaatagcctttcagatgagtgatggactttgctaccgctccggcactccatgcttcttttgcttcgtaatagttgtggaaatcaccgtggttattctttccgtacagttcggcataggaagcagaaatactgtccatcatgatacctgtgacatttgtcccggcattccaggagttacgccgttcgatgatgtcataagtctgcgccgaaactccggatgtcagacataggatccaaaggcctgttatatatattttcttcatctcactcatgcaaagattgtttttcccgttcataaaaatcggtagaagagttgtttgtatctaccagtacttcgtaacccgcttcctgtgtcgcttcttcatccacatgacggtataaactgcgtccgttgtatgtggcactttgagtgacatatcccgcatcgatggatggagaaatacgctttttattgttggaagaaccgccataatatacttccgtgccatcaatcacccagtcaagtggtatcgctatcacctgatccgtagtgcttcccggtttttgtatgacgcttccctcttttagaacgaagtcctgtatcgtggtatccttggctttaaaaataaccgcggcaggagaaaatatcgagaatgaataggcgttcgcctgaccagtcttcaacactacgttcaggtaatgatccggtgtgatctggtcgcccggagccggatgatactgtgtgttcggaaaataaacattattatagcatacaaaatatccgggtttgttcaggttgacagattgcggatattgtgccgcatggtcaaccgctccgttgatggcaatcactgcatcttctcccggctgaagcgggaacgttttaccggtaccgccaaattgccagatacactgaacgatgggagcaaagtccttgaagatagttgctccggttgcttcatcctgtgtcacccatacattagtggcttgtgaattgtaagggtcgagtgctccgaagcataaactatccagatattgcacttccgagtcgttattatgcaggataatgtacttgtcggattgataatttccttccagcggtaactttgtgcatcctccgcagtaaatctctttaataatgatcgtcccggccttggaatgaatgagtgggagattaagagatatgtctccgctggttagtttgacattatcagctaatccgttgaaaatatcctttccgcctttgtcgctgacttgtacgcggtatatacctttggtcaaagagaattgcgccactccattcttgtcggttttagccttgtaagaatttccacggtcgacatcttcaatctttacggtcactccttcccggagatgatccgtgtatccgtccggatatacggcagtaacctgcaggctgtgcaactggttgtcatacggattctctttatcgatatctgtgcatcccgcaaagatgccagtcactgttagtaataatatgtagatgaattgtttcatatagttagaatttgatacggcaagtaagtccataatagaaatccggggtgaagagagcgcttacacccgttgcatgagattttacataaggccgtgagttggtgaaattaatcgcattgagagaaagagatacatagtctccaatctctttggtgatattgatattggcagaaaaataaggatcatatccgtctgctgcaaatgtataggcattgcccgatttgcgtatcaggtaggagaattccggattcgcggcttccgctgatgtgaaaggatgcatctcattattcaggtcgaggtatgctaccggccagatagcggtataagagttaccgtcatagatacttcccccggtttgggtattactgctttcgctcacattgaaagcatattcttttccttgatactcggagatgttctgcgaacgcttcacaagcgaagcttccagtcggcacgagataatcagtctggctttcggaatacgggtgatggctgtgatattggcatccagcgagtgggtacgcttgccgttggcagtagtcgataagttgtcgccgttggcgtagatacctacatattggtaagaacgattggcaagactggtgtgcgaccatccattctgataataatacgataaagagttgtcgatgtatttcgtataagtataagcggcatctacccggaattgcgtgcgaatcggagtaatttccgggaaatcaacaatcatttccgctccgcgacgaatcacgtccattccattgtcgggagaagttgactttacaaaagtctggtcggtcactttgacatccataggagtccagtaactggatgcattgtcgcgtatgtaaaccatccctgtctggttatctacattgatttgcgggttagtcggcatagtgaatccatccggcaattggagcacatcataggagaacggagtataagtacttgcgtatttatacggcagcttggtacggttgaaataaccgactaatgaaattctggtacgggcaatgttgacgtccagaccgatttctgcgttctgattccgttgccagcgtaggttttcattgtgcaataacgtgtagggctgactataatatatataagatgattcaatcttattataggaaaagccgaaggtctgtatgtcccgatattcctgtttgggatacaaggtgtagaaagagggcagcttttcggtaattccccagccgccacggatagcgatatattcgttcaactgccatctggcattgaaacgcggagatagagtattcagatttttatatttcgttcccttgataaacaaatgttcccaacgcacccctgccatcagtctaagcatggtatttcccacaggaaatgacagactttcttctgcataaagcgaaacattatgcatatatggataagtagtgtaaggacggggacgataaccgttcggagccaatgacgggtctttgtaatattctccttcacccacattgcctgttgctttccattgaacacccgctttcaggttgctgtttacagtcttaaaccgtctgttccattcatattttaacgatgcggcataatccagttctttggagtcgatgatttggtcggcaaagtaagtatatggcagtttgtttgccataaaatatccttcctccgtggcatggacagccggttgctccgatgcataggagtagaacgtatgcgcgtgggagttgttatcattgtagtatattgatgcgtcgaacttaaggttggttatccacgatttgttgagcagccaggccagtgaagtgtttgtccggaatacgttatctctcactttgttgtattctcccgaataggcatcaggatcatctttggtattcattcctccgatattgcctgtaacaccgatgtcgaatcttaatacgttgcggaacgtgttgctatatccggcagagaatcctcttcttgtataagaagaatagggagataccaacttttgagtagccttggtccactcaccgtttatgttgatgactcctttatcgtttcctaaatccaatcctttagcaaatgaaacctgttcggtgcgaggattgatagacagcaatatgttccagggtgttttccctttccgggtgtgaatcttgaccataccactattcaagtctccatattctgccgaaggcactccggtgatgacttccaccgattcaatatctgcaacagtgatattccgggtatccactccgctcatattgccaaacgaaccattgtttccaatacgaactccatccacttctacggctgttccaaatgcggcattgccggctgttgaccctccgtcgcgtaatgagaagatattattggcggtaagatccggcactttagtctttcctcccggaaggagagcggagatatcgctcacgttggatacctgtagatgctccaatgcatgatttccgatggtgagcgtcgtgtttaattcatttttaggtgcttgtgcagtaacgactacatcatccagtgcaagtgtattttctttgagtatgataggaaggttattgatattgctgcgcacatttacgggaattgttgccggtacataacccaaaaaagaaacctccagattatatttcccttcctgtactccttgtatcgtaaattctcctttctgattggatacggcccacaaataggtacctttaatgagaatagaagtaccaggcaggggagaattcgtttttgcctcggtcacacgtcccgagattgtatagatgtttgaattagctgcggcctcaaataaattgaaaaatagtagcccccagaatgctatattaaaaagacaatacttcatagataagttttgcgcaaaattcgataaaaaacgagtttgtatcaatcgctataaatagttattttggcaaatcctgatacctataactagtgactcgttacctacgaataggtattttccctctaattgcagcttggagaataaaaaaccggcttgcattgcgattactatcacattgcaaaccggttgatttatttggcttatctatcattgaccggatattatatccagtctattgtattagatattttttactttaatcagatattcggcaatctgcacagcattcagtgcagcgcctttcttgatctggtcacctacaatccagaaagtcaatccgttttcgtttgtcaggtctttgcggatacggcctacgtataccggatctttacctgccaggaacagcggcatcgggtattctttttcggcaggattgtcctgcagaaccagaccttcaccgttagcgaatgcttcacgagcctcttctacggaaatcggacgttcagtttctacccaaatactttcagagtgagcacgtaatgcaggaacacgtacgcaagttgcgctaacttttacgtcagaatgcatgatcttgcgtgtttcattatacatcttcatctcttctttcgtataaccgttttctgtaaacacgtcgatctgcggaatcaggttgaaagccaactgataggcaaacttctctacagtcacaggttcgtttgccaatacctgacgatattgttcgtacaattcgtccatggcagcggcacccgcaccacttgctgcctgataggtagacacgtgcacggtttttatatgagaaagcttttcgatggctttcagtgcaactaccatctggatagtcgtacaattagggttggcgataacgccgcgcggacgttccaatgcatcctctgcatttacttcaggcaccaccaaaggcacatcggcatccatacggaaagcgctggagttgtcgatcatcacagcaccatacttggtaattgttttctcgaactccttagatgttcctgcaccggcagaagtgaaagcaatgtctacccctttaaagtcatcgttgtgttgtaagagtttcacctcgatctgtttaccgcggaaagtatatgttgttccggcactacgtttagaaccgaacaaaactaactcgtccatcgggaagtttctctcatcgagcacgcgcaggaactcttgtcctacggctccgcttacgccaacaatagctactttcatctttttcttttgttaaattgtgaatattgaatttctctccttatcctgtcgaatagaaaagatttggctgcaaaattataacaatttagcatataaacatcgattttgagagaaatatttcagtttttcggcggattactcatgcttccgtatagttggacgtggttattggagtgaaatgaccattagacattcattggattctgcaaacttttttgttcctttgcagaaaattcctaaaaaacacagcctatgaacctgtttgatctcaatttaacgctgccgatttctgatccgacctgggtgttctttttggtactaattatcattctttttgctccgatgattttggggcgtctccatatacctcatattataggcatgattctggcgggtgtgctgattggcgaacacggttttcatgtgctcgaccgcgacagtagttttgaactgtttggtaaagtaggactctattacatcatgttccttgccggtcttgagatggatatggaggactttaagaagaaccggacgaaaagtttcgtgttcggctggctcacttttctgattcctatggcgttgggaatatggagtagtatgagtatgctgggatatggttttctcacggcggtgctgttggcaagtatgtatgcttcccataccttaattgcttatcctattattagccgttacggattgtctcgtttgcgcagtgtcaatatcaccattggtggtactgctgtcaccgtcacccttgctttgattattcttgccgtcataggaggcatgtttaaggggactgtcgatggctggttctgggtatttcttgtggcaaaagtggctttcctcggattcctgattgtattctttttcccccgtatcggacgctggttcttccggaagtacgatgacagcgtgatgcagtttgtgtttgtgctggcgatggttttcctcggaggaggattgatggaatttgtaggaatggaaggaatcttaggagctttcctggcgggcttggtattgaatcgcctgattcctcatgtatctcctttgatgaaccggttggaatttgtgggaaatgcactgtttattccctattttctgattggtgtcggaatgattattgatgtaagaagcctgtttaccggaggtgaagcattgaaagtggctattgtgatgacagtggtggcaacctttagtaaatggctggctgcctggatcacacaaaagatctatcggatgcagtcgaatgaacggagcatgatattcggtttaagtaatgcgcaggccgcagctacactggcagcagtgttgatcggtcatgaaatcattatggagaatggagaacggttgctgaatgatgatgtattgaacggtacggtagtgatgatacttttcacttgtgtcatcagttctttggtaaccgaacgttcggcacgtcgttttgctctggatgaaaatgtgcaggcggaagaagaagctaagaaagtaaatacggaacaaatcttgattccggtggctaacccggagacgattgaagatttgattaatctggctttagtaataaaggatgctaagcagaaaaatgcattggtggcattgaacgttatcaatgacaataatagttcggagaagaaagagcagcagggtaaacgtaatctggagaaggcggctatgattgccgctgccgctgatgtgcctgttacgatggtgagtcgctatgacttgaatattgcttcggggattatccatacaatcaaggagtatgaagctacggatattgtgatcggtctgcaccggaaagcaaatattgtcgactctttcttcggacatctggccgaaagtctgttgaaaggtacgcatcgtgaagtgatgattgccaaattcctgatgcctgttaataccctgcgtcgaatcaatattgccgttccgccaaaggctgaatatgaatcgggattctctaaatgggtggaacacttctgccgtatgggaagtatcctgggctgtcgggtgcatttttttgccaatgagcgtacattgatgcgtgttcagcaacttgtgaaaaagcgacatgcaggtactccgacggaattctccatattggaggagtgggaggatctcttgctgttgacagggcaggtgaattatgaccatttattggtagttatctctgcccgtcgcggatctatctcttatgatccctcttttgaacgtctcccggcacaattaggaaaatatttctctaataatagtttgataatcctgtatcccgaccagtttggcgaaccgcaggaaattgtgtcattctccgatcctcgtggacataatgagtctcaacattatgagaaggtcggcaaatggttctataaatggttaaagaaaaactaatggaaagatacgactggcaacagagaacggaactcctgttaggagaggaaaagatggaacgcatccggaacgcgcacgtattggtcgtgggactgggtggagtaggtgcttatgccgccgagatgatttgccgtgcaggtgtcgggcggatgacgattgtagatgccgatacagtgcagcctactaatatgaatcgtcagttgccggccatgcattccacgctggggaggacgaaagcggaagtgttggcagcccgttataaagatataaatccggcgattgagctgactgtccttcctgtttacctgaaggatgaaaatataccggaactgctggatgccgataaatatgattttatagtagatgctattgatacgatcagtccgaaatgctttctgatttatgaagcgatgaaacgtcgtataaagatagtttccagtatgggagcaggggcgaagagtgacattactcaggttcgttttgccgatctttgggagacgtatcattgcggtttgagtaaggctgtgcgaaagcgtttgcagaagatgggaatgaaacggaaacttccggtggtattcagtacggagcaagccgatccgaaagcggtattgctgacggaggatgaacagaataagaaatcgacatgtggaacagttagttatatgccggccgtgtttgggtgttatctggctgaatatgtcattaaacgattataaggctattatgataaaactagaagggattacgaagagtttcggctcattacaggtgttgaaaggcattgatctggaaatcaacaaaggagaaattattagtattgtaggcccgagcggtgcgggtaaaactacgttattgcagataatgggcactttagatgaaccggacgcaggtgtggtacagattgacggaacagtggtgagtcggatgaaggagaaagaactatctgcatttcgtaataagaatattggttttgttttccagtttcaccaactactgccggagttcacggcattggaaaatgtgatgattcccgctttaatcgccggggtatcttcgaaggaggcgcacgaacgcgctatgaagattctggattttatgggactggttgacagggcttctcataaaccgaatgaattgtcgggaggcgagaaacaacgggtagcggtagcgagggctttaatcaacgatccggcagttattctggcagacgaaccatccggtagtctggatacacataataaagaagatttacatcaactattcttcgatttgagagaccggctggggcagacttttgtcattgtgacgcatgacgaggggcttgccaaaattacggaccggaccgttcatatagtggatggtatgattaaaaaagattaattagagaacctaatttctaaaaatgtataccaaaaaggtagagccttgcaagtgttctatcttttagctatatatttatagtcgcttctctacggaagtctgtgaagatgatagtagagtgtttgttttgtttgtgtgtgatgcattcttgtctggtgtgataggaatgcatcttttttttattaattataacaaatgtagggctctagccgttcaagatcaataggagtgaactcctcatagagagataattgcttcagactttttaagaatcctttctttttccgatattctatgataacctttgcttggtagtagtttatgtatggatgatgcatcattcgttccataccggttttatttacattgatgcggcgtgtctgatgggtgtcaatggaaaaccacggacggagtttctctgcctttagatgaatctcctgtaactgctctattcggaaaaagcctcccagccgttcgcggtaattcacaatcatccgggcaatgctgcttccgattcccggaatcttcttcagttcggtggtatctgcggagttgaggctgatgatagttcccgggagatatttcacaagggtgtcccgttgtatgcttggtgtggttaacaatcgtaccgtgtctttatttgtcgaactgaaatcttctgtaatttgtatataaggacgaagagtctggtattgttcttccgtgagtccatatatctttcggaaatcttccgggtggcggaatttaccttgtttatagcgatagtgcaggatattctttatcatccaggatggtaacccaagcgaaagaaaagtagtagagtctgcgatgttcggatcgaacaccgcaagtttgatttccctttgaggggatgattgaaaagaatgaccggacttttggtgaggttgggtttcccggagggaggaaataaagtcgttgtattccttatcgaacttctcgttctctctgcagtcggtatcttcagcgtgtgtgaaaaaggagaagagtttaggggcggcatatactcctaaaataagaacgacaaggacgataatgccttgtcgttcagttttagtataataaaggaagtctttccacattatagcttgattaatcccagttcattgataaatatcagtgagatggcgattggtgccatatattttaatataaagataatgagtttgtataccggtacctttaatgaaccgtcattggtaatctccgaccatacaatcttcttgtccagataccatccggtaaagagggagatgcacaatccgcctagtggtaacatgattttagctgtaacaaagtcgaagaggtcgaacatgcccagtccgaaaacggtaaatcctttcatgactcccagtgataatgaacagaatattccgaggaagacacaaccgccggtgactaaccttgctgcttttccacgggagaggttgaactcctcatgtaaataagcggttactacttcgtgcaaggaaatagtagaagttaaagcagccattgccaacaacgcgtagaacatgacagagaatatatatgccagtatgggaactccgctaaatgcctgttggaatacattaggcagggtgataaagatcagactcggaccagaatcaggttgtatgcctacggaaaaagctgccgggaagatgataaatccggctagtatcgccacaaaggtatcaatgattcctacgctgaaagctgttttagtcaggttggtttctttgctgaaataggaggcgtacgtgcaaaggcatcccattcccaaactcaatgagaagaacgcctgtcccatggcactcaaaaatacatttccgtccactttgctaaagtcgggcttgagcaggaattcgatacctgcaccggctcccggcagagtgaccgaacaaacaaccagtatgaggataatgataaacaaggtaggcatcatgatcttggaggacttttcgattcctttttctacccctttcacaatgatgaaatgagtaatcaacaagaatgccaccaaccatacaaccggtctccatgggctgctggagaattgttgaaaagaggatatgaactctccggaggtttttccggcaaagccattagtagcagcttcaaaaatatattcgagtgtccatcctgctactacagcataataactaagtatcaggaagcctgccaatacccccatgcgtcctacccaacgccaatgtgttccaggtgctaatttctgatacgctctagctgtgttagctcttgaacggcgtcctatcaggaactcggcaatcataataggcaatcccagaagaagaatgcagcctaaatagatcaatataaaagcagcgcctccatggtttcctgtttcatagggaaacctccatatattacccaatccgactgcagagccggcagaagcgagtatgactcctaatttactgccgaagtttgctctatcattttttgccataaatcttgttttatcttacaaatcgttataaaatatacgttttagagcgcaaatatagaaaatgatacttatatttgcacgaaaattgtaatattatttagatatgctatcttatattaagaaatatccgatctcgctttttatcattctgacagtgatttatctgtcgttctttaaaccgcctaagacggatttagatgaaattcccaacctcgacaaactggttcatgtttgtatgtattttggtatgtcgggaatgctgtggctggaatttttgcgtgcacatcgcagagacaatgctccgatgtggcatgcatgggtaggcgcattcctttgccctatactttttagtggttgtgtggaattactgcaggaatattgcactacttaccggggtggagactggttggactttgcagctaatactacgggagcgattctggctagtttaatagcctattatgtcgtacgccccagaatgatgaataagcagtgaatgaaaaatagaaacggtgaataatggttgcatccaatattcaccgtttatcatttactgttcactagtttatttttccgtttacaaatactctaccgttgagctaagtttgattccgttagagcctttgataagaatggtataccctttgggtttgtcagcttgcaggtcctttataacttcctgcgcattggcgtacgttttgaaagaatgttcgcttgcggcaaacagttctcctacgagccatactttctcaaaaccactttcttttatgtagtcaacgattttctgatgttcggccgggctttcagcacccagttcgcgcatatctcctaatatgagcatcttgtgggggactgtcatgttccggaagttttgcaaagcagccatcatgctggttggatttgcattatatgcgtcgatgataagcgtgttatcttctgtctttttaagttgggagcgattgttctgtggcgtatagcttgccagagcctcatcaatcttcttcgcttccactccgaagaaacgtccgatagtgatggcagccagggcattcgggaaattatattctccgatcaactgtgtgcgaacctgatggcgttcaccgtccttaccggctttccattcgaaagcgagataaggcgaattgtcagtaatctgtccgttgacatagagatcatcttcagttccataagaaatcaggttcaatccctgcgcgatattcatcaaataagcgttatcgtgatgaataaaggtgatggcatctttcttacggaggaaatcatataactctcctttagtcttaatcaccccttcgaaagaaccgaatccttccaagtgagctttacctacattggtgataataccataatccggttcggctatttcacaaagaaacttgatttctcccggatgattggcacccatctctatgacagcaaggtcatgctccggtttcaaacgcaatagggtggtcggtacaccgatgtggttgttgagattacctaaagtataaagcacgttatgggcttggcagagaacactggaaattaattctttggtggtcgttttcccattagtgcccgtaataccgatcacacgcgttccgagttggcggcgatgatagttggcaagttgctgcattgtctgcaagcagttgtctacaagtatatatcgtttatcaccttctacggcatattcggcttcatcaataatggcaaatgcgcatccagagtctagcgctagttttgcgaatgcattaccgttgaatgactcacctttcaaggcgataaacaaagaaccgtccgggcagttccggctatcagtagttactgattggcaatccagaaaaatctggtaaagagcagaaagtttcataacctgatcttttatttaaaacgctgcaaagataggctattctttcggatttgatgggagttcggacagatttttacttaggcatataccaaaggaagagtcagtatcatccggcatccgtccgtataggaagagtcgatccggaggctgcctcctaacttctcggcaatgctccggcatatcggcagtccgagaccggtgccttgtgtgaaagaattcattttgtagaaacgctcaaataccgcctcctgctgatctttcggaataccagttcctgtatcggtgacactgatttcaattttcttttcagcttccagtacggaataagctatgcggatactgccatgagttgtaaatttggcggcattatgtgccaggttgttcaacacctgtgatatgcgttccgaattactgcgtatgagcaggttttcttttgcaggttcgaacagaacttccacatccttttgcctgttgtctttggccacttcagaggcaagttgacagatcgtattcatatctgtttcatcatctgtgggcagttgctcatattgatccagttccgacagagcgagcacgtcagtgaccagtcggagcaagtcgttactgttgctcttgataatattgacaaactcctgtgtttccggactattgctgtagtgatcgcttaacacctgcgagaagcctacaatagagttgagcggtgtacggatttcatgggtcatgctctggatgaacgttgtcttcatccggctgctcgcttccgctatgtctttggctttacgtaattcttccctcgacaccgtaagttcctcattctttgttttgagttcggcttccgaaactttcagtttgcgtttcaggaaattttctctataaaggaatatgaataagatacctaataaaataatcaatgaaataatcaaggttgttttattatgcaactccttctcttgtgcttgaagcatgagttctttcttttcggcattgagcttttctacatttaataaggtggcgaattcgctgctggacacttgttcattggctattttcaaagagtcatccgtgttgatgtacatttgcagatatttgaccgccaggttcatatttcccatcttttggtagatttctccctgtgtgcggtaatggatgctgctaagtatgctttcgcttaaacgacgttcttctttttcctgcatctttgcggcttccagcgctttctgatattgtttggtctgctggtagtataaacattctatattatacagtctctttttgatagactccagtcttttgtcctgttcaaatgccgcctgacactccttcagtaatttttcggcagcttgaaagtcgccgaacttgctgtagtagtttacaaattccaacttggcagatatttgttgcgtagaggaattggcagtcgcaatggctttttccacagcagctaatgcttctttttgctttttctggttgatgtaatagttggctatctgggcataggtctgggagatgttgtagttttcgatcttgtatttttcagtcagttcgatttctttcaatcgccactcgaacgccattgaatcgaatcttttgatggtgtagatttgcgacatgatgttatagcaacgggagaggccggtcttatcatcctcttcttgagcttcttttaacatgttttgcacttcataaagtgctatgtttgttctgcttgtttttaggtaataggtgattaatctgttcgcccatgcgaagtaatagtatttaggctgatgagtggccttggcgaattcttttactttgttggtatagtggattacgctgtcttcattggttccctggaaataataataatccagttgagtggctatggctactgcctgcattcgttcgtcctgccgttcgccggccattcggaataaagtgtcggacatattaagtacaacaggctctaataagcattcttgacaacgttgataatattcatagagagtagagtcaacattgaaggtttcagcctctttttgagctttagcagtagtggtaaagaacaaaatgaggaaaagaaatcctacgcgaaatagggttaatcggctcatggtatgaatttttcgggttcttctatagtttgcaaatatacgtttatttcttctttttagtacgaatacttgctttttttatctacatttgtaggcgatctaaaaggaatgttgtcaatgatgaaacctatatctcctatttatataaatgtaaaagggcggttgctcgatcttgctactccgcaggtgatgggaattttaaatgttactcccgattctttttattccggcagccggatgcagactgaagaagacattgctgcccgggcccggcagatacttgatgaaggtgcttcaataattgatataggagcctattcttcacgggcgaatgccgaacatatttctgctgaagaagagatgcgaagactgcgcaccggtttggagattctgaaccgtaatcatcccgaagccattatttccgttgatactttccgggctgatgtggcggaagaatgtgtgaaagaatatggagtggctattattaatgacatagctgccggtgaaatggatcaccggatgtttcagacagtagccgacttgggagtaccttatataatgatgcacatgcagggaactccccaaaatatgcagaaagaaccgtcttatgataatctgataaaagatgttttcctgtatttcgcccgtaaagtgcagcaacttcgcgacttgggagtgaaagatatcattctcgatccgggattcggattcggaaagacactggaacataattatgaactattggcacatctggaagagtttcatatcttcgaacttcctgttttagtgggagtttcacggaaatcaatgatttataaattgttgggaggaaccccgcaagattcattgaacgggacaaccgtattggacactgttgcgttaatgaaaggagcgcatatcctgcgggtgcatgatgtgcgtgaagcggtggaagccgtccggatcacagagaaattaaaaatagagagtggatatgacaaataagaggagggcgcatgttttttgagtttggcataaaagattttatcgatattctgctggtagcttttgttttgtactatacctacaaactgatgaaagcttccggttctatcaaggtgttcaccggaattctggtttttatcctgatctggctggtggtgacgcaagtgctggagatgaaactgttgggctctattttcgacacattgatgaatgtgggtgtgatcgcgttgattgttctttttcaggatgagatacgccgtttcctcttgactttgggatctcaccgacatgtcagcgcactggcccgtctttttaacggttcgaaaaaagagtcgttgaagcatgacgatatcatgccggtggtaatggcttgtttgaatatggggaagcaaaaagtcggcgcattgattgtcattgagcataacgttcctttagacgaagttgtccgtacgggcgaactgattgatgcggcgatcaaccaacgtttaatcgaaaatatattcttcaagaatagtccgttacacgatggcgcaatggtaatcagtaaaaaacgtatcaaggcggcaggatgtattcttcctgtatcccatgatttgaatataccgaaagaacttggcttgcgacatcgcgcagcaatgggaatctctcaacagtcggatgctcatgctattattgtttcggaagaaacaggcggtatttccgtagcctatcgcggacaattctacctccgcctgaatgcggaagaactggaaagtctattgacaaaagaaaactgattttattgtaatcacataccggacaaatggtcggaagatgagcatggtaaaatgcctctcatcttccgaccattgttgttttatctgctatttggcgctattttgctttatttccaaccctttttgaatgataattatgccctcctttttaggtgaatcgcctacctttgccgtatactattaaaattctatttttgaataaaccatgaaaaacagattgattgctttactggtactttttacagttattttctttagtactgcacaggcgcaaactactgcacggaagtttgaggcaggcaagaacacattcttgctggatggaaaaccgtttgtggtgaaggctgccgagttgcattacacccgcatcccgcaagcttattgggaacatcgcattgagatgtgcaaggcattaggcatgaatactatttgtatttatattttctggaatatccatgaacaggaagaaggaaagtttgatttttccggtcagaatgatattgcagctttctgccgtgcggcacagaaacacggtatgtatgtcattgtccgtcctggtccgtatgtatgtgcggagtgggagatggggggacttccctggtggctgttaaagaaaaaagacgtagccttgcgcacgcttgatccttattatatggaacgggtaggtatttttatgaaagaggtcggtaagcaactggctccgttgcaagtgaataaaggaggaaatattatcatggttcaggtggagaacgagtatggctcttacggaacagataaaccatacgtatctgccgtacgtgatttggttcgtgaatcgggttttactgatgtgcctctgtttcaatgcgactggagcagtaactttaccaataatgcactcgacgatttgatttggactgtgaatttcggaactggggctaatatcgaccagcagtttaagaaactgaaagagcttcgtcccgaaactccattgatgtgtagtgagttctggagcggatggtttgaccattggggacggaaacatgaaacacgtcctgcgaaagacatggtacagggcatcaaggatatgctcgaccggaatatctctttcagtctctatatgactcacggaggaacgactttcggtcattggggaggtgcaaacaacccggcttattccgctatgtgcagttcgtatgattatgacgctccgatcagtgaagccggatggaccaccgaaaagtttttcttgcttcgtgatttgttgaaaaactatcttccggcaggtgagacgttgcccgcagtgcccgcagctctgcctgttattgaaatccccgagtttcacttccataaagtggctccgcttttctcaaatctgccggaggcaaaacaaacggtggatattcaaccgatggaacaattcaaccagggatggggaacgattctgtatcgtaccacattgcccgaaacgactcttgcaggcaccactttgaaaattacggaagtgcacgactgggcgcagatatatgccgacggtaaactgctggcacgcttggaccgtcgtaagggagaatttacaacgaccctgcccgcgctgaaaaaaggcatacaactggatattcttgtggaagcaatgggacgtgttaactttgacaaatccatccacgaccgcaaaggaatcactgaaaaagtggaacttatttcgggtaaccagactaaggaattgaaaaactggactgtatataacttcccggtagattattcctttataaaagataagaaatatagcgatacaaagatattaccgactatgcctgcctattataagagcacctttacactggataaagtaggagatactttcctggatatgagtacatggggaaaaggtatggtctgggtgaacggtcatgcaatggggcgtttctgggaaatcggtccgcagcagactctctttatgccggggtgctggctgaaagaaggagagaatgaaatcctcgttctggatttgaaaggtcctacccgggcttccatcaaaggtttgaagaaaccaattctcgatgtgcttcgtgaaaaagctcccgaaacacaccgcaaggatggagaaaaactgaaactgacgggtgagaaagtgggccatgaaggagctttcactccgggtaacggctggcaggaagtgcgatttgccactccggtgaaaggacgttatttctgtctggaagcactttctccacaagcaaatgataacatcgcagcgatagcagagtttgatgtcctgggagctgatggtaaaccggtatcccgcgaacattggaagattcgttatgccgatagtgaagaaacgcgtagtggcaaccgtacagccgacaagatattcgacttgcaggaatccactttctggatgacagtggacaatgttccttatcctcatcaattggtaattgacttgagcaaagtggaaaatgtgaccggtttccgctatctgcctcgtgccgaaaaagggtatccgggtatgattaaggaatatcgtgtatatgtgaaacctgctgatttcaactactaaacagtgaatgaacaagaataaaacaatggatgaaaaagcattgaaatgatgatgaatatgaagaaaaatataattcttttcgcattcctatttgtgggagtgttgactgggtattgccagcaatctgcttacctgtttgtttacttcaccggcaatcgcatgagtgaagaagccgtccggatggctgttagcctcgatggatataattataaagccttgaatggagatcagccggtacttgattcccgtgtgattagttcaacaggtggagtacgtgatccccatatcttgcgctgtgaagatgggaagacattttatatggtggtgacagatatggtgtccggcaatggatggagttctaaccgtgccatgatattattgaaatcaaaagaccttgtacactggacttccaatatcgtgaatatccagaaaaaatatcccaatcaggaggatctgaaacgtgtgtgggctccacaaactatttatgatagggaagcaggaaagtacatggtttactggtccatgcaacatggcaatggtcccgatatcatttattatgcttatgccaacaaagattttaccgatatagaaggagaaccgaagccactgtttcttccggaaaacaaaaaatcatgtattgacggcgacattatttacaaagatggactctatcatttgttctacaaaacggaagggaatggaaatggaattaaaaaggccactacctcctctctaacctccggccaatggacagaatcggatgactataaacagcagacgaaggatccggtagaaggttcgggtattttcccgctggttggttccgataagtatattttgatgtatgatgtatatacgaaaggtaaataccagtttaccgaaagttccgatctggaacatttcaaagtgattgaccatgctatcagtatggatttccatccgcgccatggcactgtcataccgattaccccaaaagagttgaaacgcctcttcaaggcctatggcaaacccgaaggtttctgaactaaaatatctcgtgggacaggagaaaaacacctgtccctgatttgttaaaccaattgtttttcaggcgggtaatcttcgcttcccagtgagtattcccatccttttgttttcttttgagttattctgataagatggattcaactagttgtaatccaggaaaacagtatacggtatggggaaaagtgtatattttacccttgtttacttgtttcttatatatttttaagtgtataattaccaattattatatgaaacacgcttgttagaatgatgaaaatcttaactttgcgattgataatcttaatgcaatatataccatgagaaaattattcctctttttagttgtcttgtttttgtcgttccagcagctcactttagctgcaatcaaagaaatgacgagtacacccgattcggtttatctgttttcttttgcaacttccggagacgacggacgcagcggactccgttttgcctggagtacagataaagaaaactggtttgaaattggccggaactacggatatctccggtgcgattatagccgctggggatcacagaagaaaatgctcgatccttatttgaaacaatcgtccgatggcgaatggatttgtacctggaaactgaatgaccatgatggatacggccaagctacttccaaggatttaatcaactggaccagtcagaaatatccccgtactacgccggattttgacggagtgagagtgaaagctattgttgccggagaagagcagaaaggaaatatcaaccgggtagtttggaccttggtggatggattggataaaaattatggctggaatcaatatcggaactcattacatggagaacgtccggtacaggatggagaacgttttgccggtttgaagcctgtaaaagcaacggtcactgtacaaccggaaggcgcaaaagccattagtgatgtattgctgggcgctttttttgaagacatcaattattcggcagacggaggactctatgcagaacttatccaaaaccgcgacttcgagtacgacccttcggacagggaaggagataagaactggaacagcactcattcctgggcactgaaaggagagaaaacgactttcactattgatactaccgaccctattcatatcaataacccacattatgccgtgctgaatgtagaacaaccgggagctgcattagaaaatacaggttttgatggaatcgcactgaacaccggagagaaatatgatttttccatcttcgcccgtgttccgcagggtaaatcaaataaattgcaagttcgtctggtagatggaaaaggaaatgtgtgtggagaaacttctctaacagtgtcttcccgtcaatggaaaacatataaagcggtgataactgctaaagctactgcggacactcatctcgaaatcatccctcaatctgttggtgaattgaatctggacatgatttccctattcccgcagaatacatttaaaggacgtaagaacgggcttcgcaaagatctggctcaagtgttggctgatattcatccccgtttcatccgtttccccggtggctgtgtggctcatggtgatggcttgaaaaacatttatcaatggaaaaatacagtaggtccgttggaagcaagaaaagcacagcgtaatctttggggataccatcaaagcatgggattgggttattttgaatatttccggttttgcgaagatattggcgcggaaccgcttccagtgctggcggccggtgttccttgccagaactctgcctgtcacggcgacttgagaggaggacaacaaggtggtatcccgatgagcgaaatgggagcttatattcaggatattcttgatctgatagaatgggcaaacggtgacgctaagaagaccaaatggggaaaggtacgtgccgaagccgggcatccgaaaccattcaatctgaaatacatcggtatcggaaatgaagatcttatcactgatatcttcgaagaacgcttcacgatgatcttcaatgccatcaaagaaaaatatcctgaaatgattgttgtcggtacagtgggaccattcaatgagggtacagactacgtggaaggatggaaactggcggacaaactgggtattccgatggtcgacgaacattattaccagactccgggatggttcctgaacaaccaggatttctacgacaaatacgatcgttcgaaaaagacaaaagtatacttgggcgaatatgcaactcacataccgggacgaaaggcgaatatcgaaacagcactgacagaagctctttatcttgcagccttggaacgtaatggagatgttgtacacatgacttcctatgcccctcttctcgctaaagaaggacatacccagtggaatccggatttgatttacttcaataaccgggaagtgaaacctaccaccggctactatgttcagaaactctacggacagaatgccggaaacgaatatttgccgtcaaagatcactcttgataatagagacgatcaagtacggaaacgcattgcttcttctattgtccgtgactcggcaagtggcgacgtgattgtgaagctggtcaatttacttcccgtagaggtgaatacgaatgtcgacctttccggaatcggtgctatacagtcttctgcaaaaagaaccgtactgaccggcaaaccggccgataccccgctacctgttgaagacacaatggaagtagcagaaaagtttgactatcaattacctgcctattcttttacggtgatccgcataaagaaggcaaatgagaaataacagaaaaaagtgaagataataacgatataaataatatgaagaagataataagtaccctgctggctagttgctgtctgacttctctgatagcacaggaagtggtagtgaaagggccggatgaaaaactgcaattgattgtatctgcttctccagccgaaaagccgagttattcgattacctacaatggaaaggcaatgttggagaaatctcctttgggtatgaatacgaatatcggtgactttgcaaaagggatgaaactgacaggacacgctgttactccgatcgatactgtctatcatcaggatcgtattaaaacctccaaagtgcattatcaggcaaacgaactgatttgtaattttgagaatccgaaagggcagaaaatagatgtagtctttcgtgtcagcaatcacgatgtagctttccgctatactcttccgcgtcaggatggaaaaggaagtgtaacggtaactgccgaagaaaccggctttcgctttccgcaacagacaactactttcttatgtccgcaaagcgatgccatgataggttggaagcgtacaaagcccagttatgaggaagagtacaaagcagatgctcccatgagtgaccgttcacagtacgggcatggttacacgttcccttgtctgttccgtatcggtgatgatggttgggtgttagtcagcgaaacgggtgtagacagtcgttactgcggttctcgtttgagcgatgtaagcgaaggtaatctgtatacggttgctttcccgatggcagcagaaaataacggtaacggcacttctgctccggcatttgcccttcccggtgctactccctggcgtaccataactgttggcgaaaccttgaaacctattgtggaaacaaccgttatctgggatgtcgtacgtcctctttatgaaacgaagcatgactaccgtttcggacgcggcacatggagctggattctctggcaggatggtagtattaactatgacgatcaggtgcgctatattgattttgcagctgcaatggggtatgagtatgccttgatcgataactggtgggatacgaacatcggccgtgaccgcatgaaatctttgatagaatacgcacgaagcaaaggagttgaactcttcttatggtatagctcttccggctattggaatgatattgagcaggggccggtgaatcacatggacaatgctattatccgcaaacgtgaaatgaaatggttgcaaagtcttggagtgaaaggaatcaaagttgatttctttggtggcgacaagcaggaaacgatgcgcctgtatgaagatattttgagtgatgctgacgaccacggtctgatggtaatcttccacggttgcaccatccctcgcggatgggaacgtatgtacccgaactatgtaggcagcgaggctgtactggcctccgaaaatatggttttcggccagcacttctgtgatgaagaggctttcaatgcctgtctgcatccgtttatccgcaacgcggtgggttgcatggaattcggtggttgtttcctgaacaaacggctgaatcgcaacaatgacggaggaactacccgccgtactactgatatatttcaattagccactaccgtattattccagaatccggtacagaattttgcgcttgctcccaacaacctgaaagatgtttcccctgtttgtgtggactatatgaaaacggttcctaccacgtgggatgaaacacgtttcattgacggatatccgggaaaatatgtggtcttggcacgtcgccacggtgacacctggtatctggctgctgtgaatgccgggaaagaaatcgtaaagttgaaactggatttagatatgtttgccggaaaaatcgtttctctgtataaggatgataaaaaaggagaacctcaacttgtgacgttgaaagtaaaagaaagcggaaaagtgcaactggaaatccttccacagggaggtgttgtattggtgaacaactagatgatatttcttttggatgtgagttcgggataaatacccttatcccgaactcacatttttatttgttatttacttgtggcttggtggcaacagtatttattgtgcaataaataactgctgtgtatgaggaaaataaacgatttttttgttggtcttttagcgtaaagatgttatcttcgtttattgttcaaccttaaaacggaaaaccatgcatacaaaactagtaagtcttttcatagcgttgtttctgtgtttgccattgtttgcacagaaagagtcagtccccagaatagatagtgagggagtttatttaattcccgatgagatgccgaagtttccgggaggcatgcaagccatgatgaaatacttggcaactaacgtaaaataccctgtcgaagcccagaagaaaggagtttccggtcgggtgattatccagttcgtagtgatggaagatggaacaccgggacagggaaaggtagtgagaggagttgatccgctgttggatgaagaggctttgcgcgtggtgaaaacaatgcctaaatggtcacccggaatggcggatggcaaggctgtcaaagtgcgtttcactattcctgtaatgtttagcctgtcgaaaaagcaaaatggcaatactccgaatatgaatattcctgaacttactgtccctagcggtcaggaagtcactaataagagtctggagggagtatggcaaagctgtcttgtgcagcccggtgcacatgattttcggattgcattattaccggtcttaaaagtaatttctgccgataaaacatttataaacatcatgacacgtggcagggatgcgaaatcgaatgccattatattttcccagggagagtatcgtttgccttcagacagcgtgtatgtcgagatattgggaaaatcgtccgatcctgttttcgttccgggaacagagaatgaaattagtgttgaacgtctccacgacaatctgattaagttatcgttctcaatgcccgataaagaaaaacgatgggtggagtattggttccgtgttccgtcgcctgatgtgaagataatggctgattgataatttctctctgtatagatttgccattgttgaaggaagagtacattcgttttagaagacttatttgaaacgatagttcccggaaagttccgttttgaatcgttgcgggatcttatggaaattcaagaaaatacccttcacctttcacaatgccctattcatcggcattagcgggtgaagggtaggctttcactttcctttcacctttctaccctggttttcacagattgtctagtctgctaaatcttttatctatagttggcagaagaagtgttagcagatagcttccagactattataggaaaacttcttttctataagggataaacttcctttgtataggaaccaaactttctttgcatcataagaaaactataaatgcaagctttgattatataaatgaaacttgcatttatataatcaaagcttttgtttttataaacgcaacttgcaattatagattgcatttaatgaaaaacaagtttacatactggtaataagaagtttactagtaatcaaaagaaagtttgttattaatgaaaaagaagttagttagtaatgagtgggaaacaggttagatatgtttttagaagtaacaggtggagaagaattatacagggttaagaaaacggagggtgaaaggcggatgaaagagcagccttcacccgctaatgccgatgaatagggcattgtgaagggtgaaggctgtacttgtaaaattgaaaaacaggtgttagagggaaatttaccgattggttactgtttatttccccagtgtgagatggtgggaataaagttgaaactttataattttaagtctactctctttcccctataagaaacagattgatcgaatgtcgtagcatcaccgtcaccacaaccttttcccggttctacaatgataatgttgaatttacgatttttcagcattcctttgtagttaccttgccggtcgttaatcgtcagggtacggtctttatcattccatttcatggcaatggtagtgtatgctcccttttcgtaattgtagttgtcgaactcatcttcgtaaagagtaaattcagcgtcggcgcccggataaatgcgaagtgtcagattatcccatttcttttcggtggaatattgtacagccggtccccagggtaggatagaaccagcacggacatagacaggcatgatgtcgataggcacttcacgctggatggtttgtccgcctttcaggcttttcccggtccagaaatcaatccattgggcacctgcgggtagataaacatctgtctttcctatcttattcatattcttctgatagccgttctgtttgtcgtcctgccatgtataaagcgaatcagttacggggcggacaaggaaattacggccaaacatatactctgtatccatctcgagtactttcttatctttaggaaaatccatcatgagtggtcggatgatactgcccgctttgttggtaacttcccatgaagtgctgtagagatagggcaaaaggcgatagcgcaggtgagtatatttttcgagtgcgtcataagcccagtctcctttcttgccaaactggtatatttccacagctaccggactggaattgtgtgaacgcatgatcggctggaatgctccccactgataccagcgcacgtgcaattcatgataagcgatattgtgtacattattgttatatttccgtgcgaagaagccgcctaggtcggtattccagtatggtatgccgcatagtgagtaatttagtcctgccgccagttgtttcttcatcacttcccaggtagagactacatcaccgctccatgaatgtgacgcataacgttgctgtcctaggaaagacgaacgtgtgagcaggaatacccgcttgtcggaagtggtagcacgttgatgttcgtatacacccttgttggacatcaaagggaaagcgttgtgcactctgcggaatgaacctagataagtgggggtgtcgaaatctttgtccttgatttccagatgatccggctcggtagagtcgagccaccaaccatccataccgagatcgaagatgttctttttcatttctgcccaatacatatcgcgtgctgtcggattgaacgggtcgtaaggttttactccggctttgggaggccatgtctcgaagtgaagcaatgctttcaggctatccattttctggtacatctctgtccacggaccgaacgaggcccatactgaaatcatggtatgtgcattctgtttatgtacatagtcgatcatttctttcggacttttgatgcgtggcgttccataattagcatttctgtcttctccgttcgggaggaatttcatgtattccggatcacccattttgttgatatagcgtgggttttggaatttcatcgagttccagttttcgttgcatccccaatattgccagtcttggatgataccgtccaaaggtactttcagttcacggtacttatctactacttcgcagagttcgtccggacttttatagcgttcgcggcattgccagaatcccagtgtccagagcggatagagcggggcctgaccggtcagctcgcgcactccggctattacaccgtccgcattgccgccgtaaatgaaataataatcagcgcaatcgcctacttccgagtcgaacgacatctcttgcggattgtcgaggaaagtagtaggagagtaattatcccaataaagggcatatcccttgacggaatgaatgaatggaatgcagatactcatattttgattgcggagaaacagtttctaattgcgttggttcactttacccgtctgctgctgtcccaaaccgtagattacttcgtctttatccagcaaaaaggcctggcggacattgaaagacggaacacctgcatcattgaaaggagtgaattgtgttccgtaatccttgtccgtcaacagacgttgcccggacgaatcgaaaaaatggataccaccagtctccgggttcacttccacttggataagacggctgcttaatgtcacatttttccccttttcaccgaaagaaacaggagtcgactcgggcgttttgacaatgaccagactttctttattgcaagatttctgactgggcgtcttataaaccctgacaatggagggtgaataaaactctacgttgacatccatcccctgtgtggcacacttgatgccttgtgaggtacgctgtacattttgtgctgtaccattgcctgctgcaaccattgttgcacatacaagcaagaaaccggcttttctaataagattcattttcatggtttttaagtactttatgatgcagcaaaagtagggcagaggcaagcaaaacggacaacaatcaggttgaaacaaacagtaatcacgttgattccttcgctttttcggcatattctgacgggcggcatccatacatttcctgaaaacatttgcttaaataactggaactgctaaaacctgtgtgttccgcaatttctgtaatacttagcttgccctctgttatcagttgtgctgcccgttgcagacgaatgttacggataaagaggctgggagactgatcgagcatagtcaccagtttgcggtataatcccgttcgctccatacagaggtcgcggcttagttgctccaccgaatagccattgacgtgcagattctgttccaccagtttgatggcttgtgccagaaatgcagattcttctgtgtcctgttgctgatggtcgggagacgtttcttctatgccacaggttagagaattattttgttcgatcaggttgcggatacggagtaatagaatctcttctttatgcttgcgttccatttcctttctgctccaatagatatacaatcggctaccggtgaaagcaatcagtaataaaatgactgcatacaggatataagccgtggttgttttccaccacggtgcatggatggttaattttattgctgtcactttgccgttccactgaagaggattgtccgaggccatgactttgaatgtataatctcccggtggtaaattggtgtaaacagcttgaagaagacctttccctacagtcgcatttccctgtcttcctgcaaatgtactcatccattgcgggtcgataccttccagttgataacggtagtatgtgcgttcatgattgatataattcaatgccgaaaattcgaaagtcaggaagttttggttatagtccagttcgatttcggttgtataaggagcagccttggacaggatgatgcggttgccatattcttttccagtattcactttctctccatacaagcgtaaggctgtgaaaaccggcggatcaggaagcatcggatgaatggagtccttgtcgggatggaatatgctaaagccatcaataccacccagatagagagtaccgtcggaagaactgaatacggcatcttttatgtattcgccgtccaaagcaccgtccaactgattgaaccgggtgaaactgatgttcttattctccggatttatgtggatgcgtgtgacaccgttactggtcgttacccagatgtctcgatatttgtcctcaataatgccctggataaagttattgctcaatccgttttcacgatagaagatacgtggggcagagtcgttttcgctggtaaaaagttccagtccgtcaggagttcctgcccatgtccagccgcgtgtgtcggtatataatgtattgtatactttatttctgaaatgatggttcttgttggggggcaaccgattcaggatttcaggagaatttgtagggatagctgccggcttcaatacatgggatttctgctcattgactgtcagtcgataaattcgggaatgagctttcagatagatatttccatctttatcttcggcgaaagattcaatattgatttcttcttccggggagacgggaaatgcattgcgacctatatgagtcagtttatgcatggacgggtgatgatataataaaccccgattgaaagttccgagccataaccctccttgtcggtcttgaaagacagtgctgatttcggtagagacaatctgtccgtttccggtttccaatagggggatgtatttttgtgttcctgtgtggaggtcaatcatccaaaacccgtgaatgcaactgatataggctttctcaccattaggggtaatgataagggtgttgagagtatagttctgttcgaagagttttttccatgtgcgtttgtggctattgaaatagaataaaccgcctttacgcccgttgcgtagttgatagaagccgtctgcacttttgacgacgagagaagtattttgatattcagcctgttcggatgcaggataagcggctatattgtatacagttttttggtcggctatgtggtaacaggacacttcgcctgtgtcatagaataaatatagggaggtactgtcggcattcaggtcctgcaattttccggaatacttgccgggcaaggttatacgggtcttgttgtttaattccagtaattcgttagctatgagtagccagatgtgtcctgaatcgtctacaaaaaggtcttctacgggggcttgtatctctctgttcttaaagtaagcatctaaatcaggaatgtattcctctctgtacaggtcaatgcacatcagtttgtgagtatctttaatccataacagagaatccccactctggtaaatgcggtaatgcccgttatattggtttaatggatatacgtattccgtggtgcggtgaagatagctgaaatgtactccgtcgtataaatttacattaccgctggtggtgaataccattcttccatcgggcaactggaggatataacgtatttggttatcactcaatccttgcgacgcattgatggtggtgaacaggaattcaccggcatatatgaacggtgtcatcctgaaacagaaaaataagcagagcagaatccgtatgtttctcaaactattggtagtcatggctatgtttcaagattacaaagataaaaaaagtcggcttatgaagcacgacttttctatctgttaagggcagttatttatcattcagctgaaaaaagtggcattttgacttaaatttgggcttttatgaatgatattcagacgaatgtttgtatataaagctttacttttgcgatgaatctgacattataaacatatcattaccatgaaagcaagatttgcattatttttattgtttgctattttatcattaaaactctctgtggtctttgcgcaggaaaacatattcaccgtccggcagccggattatcagaaaagcccttatacgggaatgactcgtcagcactggatacaggcgggcgagtatttattaaaaggtgcatttaactatatacatacattagacgatcaaatgtattttccgaaacagctggataaaacatatccgagaaatacgggagaaattccggtagcgaagctggaaggtctggcacgaactctatttgtagctgcccctcttttgaaagataatccagaactggagatgaacgggataaaagtggcagactattatcgttatcaactgataaatatctctaaccctgaaagtaaaagttatattccgcatcgtacgggaggtcccagtcagacattgttggaactgggctctttagcaatctcgatgaaagctgcgcaggaagtgttatggaatcctctgactaagaaacagaaagattcactggctgctaccatgttgagttatggagagggaccgactattggttccaactggatgtttttcaatgtctttatcttgagttttctgaaagatcagggatatgccgtgaatgaaagctatctggagtcgaacctgcaaaaacttctcgcacgctatcggggcgaaggctggtacaatgacgctccggcttatgactattatagtgcgtgggcttatcagacttacggacctatttgggcggaaatgttcgggaagaaacaataccctcaatatgcaaggcagtttatggaaaatcagcatgacatggttgataattatccatttctgttcagccgtgatggcaggatgaatatgtggggacggagtatttgttatcgttttgccgttactgctcctttgtctttgtatgaatatgacaaaagtggtaatgtgaattatggatggatgagaaggatagcttcttctacgttgttgcaatttttagaacgtccggaatttctggaagatggtgttccgacaatgggtttctacggaccttttgctcctgctgttcagatttatagttgccggggtagtgtttattggtgcggaaaagcttttcttagtttgttgttgccggaaaactctaactattggtcggctacagagaataacggtccttgggagaaagaactgaaaaaaggggaagtgtataataagttccagcagggaactaatctattgataaccaattacccgaattgtggcggaactgaaatgcattcatggtgtcatgagactgtggcaaaagattggcagaaattccgcagtaccgaaaattataataaactggcttaccatacagagttcccctggatggcagatgggaagaatggggagatttccatgaattatggaacaaggaataaaaaaggggaatgggaagtgttgcggttgtatacgttcaaaagtttcgaaaatggaatttatcgtcgtgacgctgtgctcgaaacggatagcactgtgaagtatcagttggcggatattcctctgccggatggaattctgcgggtagataaggtgactgtttcagaaccggcggagatttgtttgggacattattccctgcctcgtctggattccgatataaaggaaacatgttgcaaggtgggtaaacagaatattccggtactctctaacggaaaatatgaattggcaatgataccattgacaggttgggagaaaacatatacggtatatccggagggagtgcatcctgtaagtgagaaatgtgcattaaatatggtttccgatcagttatccggtgaaaaaatatatgtgacacttcaattatggaagaagaatgagaaaagaggttttacttcaaaagagctgacaccggtgaaatctgtccatgtgtcagaggataagaaacaggtgacggtttgtttatcaaacggtgaaataaaaactatttcgtttgagtaatgaatcccattcaagtaactgatatttaattaagaaacatattgctatcatgaaagagaagattgtttggatttttgtcgttttatatctgtgtagctttcatttgaatgcccaaaatgcagaaaataatcctactggcggcgggtatcaagttgcagctgaaggagcttggtgttggtttgccgatccgagagccttgcattatgaaaacaaggagggaactataaataagacatatatcggttacatcgatattcatggtaatataaaggcgatgcagtatgactttcaaaagaaggaacaggaagaagtattgatccgttcgtattttcagccggacgatcataacaatcccacttttcttgtattgcccgatgaaagaatcatgattttctattcaagacatacggatgaaccttgtttttattacagagtctcccgaataccgggggatattactactttaggtgaagaaaagaggattgaaacaaaaaataatacgacttatccttctccgtttattctgtcggatgatcctgaacatatttatttatgctggcgtggaatcggttggcatccgactattgccaagctttcattaccggacggcaaagatgaggtggatgtagtatggggaccgtatcaaatcgtacaatctaccggcgcccgtccgtatgcgaaatacatgtctaacgggaaagataagatttatttgacttacaccacgggacatccggataatgaacttcccaacttcctttattttaattatatcgatatcaaaacattgcagttgactgatgtcaggggaaccgtactttctactattgccgacggcacatttaaggtgaacaagacaggtgattatgcgaaacaatacccgtctacggtagtggataatccttctgaacgtgactgggtatggcaaatagcttcggacaggaacggaaatccggtgatagcaatggtacatatcagcgataataaagaatctcatgattattactatgcaaaatggaacggacacgagtggaaaaagacttttcttattaatgccggtggacattttcatcagacgccgaatttagaaaagtgttatagtgccggtatggctatcgatccgtcgaatgttaatgaggtatattgctcattaccggtagagggaaaatatggtaaggtgtatgagattgtaagatttatcatgagtgaagatggagaggttatttctaaggaggcagtcacaaaagactcgcaactgaataatgtccgtccttatatgataccggcttcagagggtaccccattgcggctgacttggatgtatggcaactattatgattggattgtcagtttacaacatccacaaggctattctacaggaatagcctgcgacttcaaaggattccccgatagaaaaaagaagaagatgatagcggcatccggcaaagaaatacgatttgatcctgaaaaaccttttgtgctggaacagacgattactcttggcgcagataattatcaaggttgcttgttgcaactcggtgatctggaatattatctaaacggagaaacgatgaaacctgaaatcagatataaagggaaggtatataccagcacaaatgtattgggaacatcggattgttggaaaacacaggctcgtggaaccggtggcaagtggtatactccgcagaaatatggggaggttcgtttgaggatggaatataagaaaggtgttttatgtgtatatataaatgacttgctcgatcagagaattgactttgattgaaagcgagcgaactcttttatggagtgggctaataagtggaatcctcgtttatatcgtattatataataaatgaggactaagttcgaagtacaaattctccataatatcatacatttaatagagaatgattgtttttagcccttttttgacatataagtagacctttatattttatgtatcatctatctttgtagacaagaaatcttatttaatatcatgaatatgaatagacattgtggaataattaagtttatattattaggggtggtttgtatatcattactgcctgtatcagtgcatgcacagaagtatacggagtttatccccggtgaagtttggaaagatacggatggaaatccgatcaatgcccatggtggcggccttctttatcacgatggtacttactattggtatggcgaatacaagaaagggaaaaccattttgcctgactgggctacgtgggagtgttatcgtacggatgtgaccggagtaggttgttactcttctaaagacttgctgaattggaaatttgagggtattgtacttccggcagttaaagacgatccgaatcatgacctgcatccctccaaagtattggaacgtccgaaagtggtttataataagaaaacgggcaaatttgtaatgtgggcccatgtggaaagtgctgattacagtaaggcttgtgccggagtggcagtttccgattctcctgtcggtccgttcgtttatcagggaagttttcgtccgaacaatgcgatgagccgcgatcagactgtttttgtggatgatgatggacgtgcttatcagttttattcttcagaaaataatgaaacgatgtatatcagtcttctgactgatgattatctgaaaccgagcggacgttttacacgcaatttcgtaaaagaatcgagagaggctccggcagtatttaaatataatggtaaatattatatgttgagttccggttgtactggctgggatcctaatatagccgagatcgcagtagccgattctattatgggaacatggaagacaatcggaaatccttgtacgggaccggatgcggataaaacgttttatgcccagagtacttatgtccagcctgttgtcggaaagaagaatgcatatattaccatgttcgaccgttggaagaagaaggatttggaagattcccgttatgtatggctgcctgtgttggtaaaagatgggaaaataactatcccttggcatgaaaaatggaacctttctatctttgacaaataaaaaataaatatgaaacggatactgctactactttgcggaataatgctcgttcccgttattgcctgttcccagcatttggttgaagtgggaaaggggtatagctgtacttcggtcaatacgacggtctttcggaataattcgctggttacacacggtgatgaacaatatatcagttattacgataacgatggctatctggtacttggaaagcggaaactggattcggaacaatggacattacatcgcacccaatatcagggaaatgtgaaggatgctcataatataattagtatgatgatagatggagaaggatacatgcacgtatcttttgaccatcacggacatccattgaattactgccggagcattgctcccggttctttggaactgggggataaaatgcccatgaccggagttgacgaaggaaatgtcacctatccggagttctatcctttatccggaggagatttattgtttgtttaccgctccggttcttcgggtcgtggaaatctggtaatgaaccgttattcgctgaaagaacacaaatggactcgtgtgcaggatatactgatcgacggagaaaataaacggaatgcctattggcagttatatgttgatgagaaagggacgattcatctttcatgggtatggcgcgagacctggcatgtggaaacaaaccatgatatttgttatgcccgttcttttgataatggggtaacttggtataagacgagtggagaacgatatgaactcccgatcaaattgtccaatgcggagtatgcctgtcgtttacctcaaaactgtgagttgattaatcagacgagcatgagtgctgatgcaggaggaaatccgtatatagctacttattggcgggaatccgacagtgatgttcctcaataccgcatcgtctggaatgacgggaagatgtggcatcaacggcagataaccgatcgccagacaccttttaccttgaagggtggaggtacgaaaatgatccctattgcccgtccgcgtattgtggtagaaggtggagaagtcttttatattttccgtgacgaagaacggggaagccgtgtgtcgatggcacatgcgactgatgtgggtacgagtaagtggacgataacggatctgacggatttttcggtggatgcctgggaaccctctcatgatacggaactttggaaaaagcagcggaaactgcatctctttgtacaacacacccgtcagggagacggtgaacgcacagcggaaattgagcctcaaatgatatatgtattggaaacgaatatggatacaaataaataaagatatgaagaaactatatgtaactcttttttctgcactctttctaggcggtgcaatctgtgcaagttgtacggataagaaggatgcttctgctgaagaagtgataaacactattcataaagtgaataattattggcagacgaatcatccggaacacggacgttctttttgggataatgccgcctatcacaccggaaatatggaagcttattttttgactaagcagccggagtatttggaatactcgaaagcctgggcggaacataatgaatggaaaggggcaaaatcagatcataaggaaaactggaagtacagttacggtgaaagtgatgattatgtgcttttcggtgactatcagatttgttttcagacgtatgccgatctctataatatggaaccggatacacagaaaatagcccgtgcccgcgaagtgatggaatatcagatgagtacccccaatcatgattattggtggtgggcagatggcttatatatggtcatgccggtcatgacaaagatgtataacattactaagaatccgctctatttggagaaactgcatgaatacctcgcctatgctgatagtattatgtatgatgaagaggccggactttattaccgggatggaaaatacgtgtatcctaaacacaaaagtgtgaacggcaaaaaggatttttgggcacgtggagacggctgggtattggccggattggcaaaagtcttgaaagaacttcctgaaacagataagtatcgtccggaatatatagatcgtttccgtaccctggctaagtcggttgctgcttgtcaacagccggaaggttactggacacgcagtatgctcgatccattgcatgcaccgggaccggaaaccagtggaacggctttctttacctatggtttacaatggggaatcaataacggtttcctagatgctgcagaatatcagccggtggttgaaaaagcatggaaatatctctcaacagttgctttgcagcctgatggcaagattggttatgtgcaaccgattggtgagaaagcgatacccggtcaggtggtagacgcaaactccacttcgaattttggagtaggtgcgtttctattggcagcctgcgaacgggttcgttatttgaataaataaatacaggcacggattacacgggtttcgcagctcttagaggcatgccttaatataagtcaacagcgtaatccgtgtaagccgtgcctaaaatttaattcagcatcaagctcatatatggctttaacggctgaagtattctattggttaattcgctaatattcatctgtatatgcgtaccgggcagtcgctcggtactatacatgcacttccctttacacaggtaataataaccgttattgacagataattgtttatccgataattccaactgcatttcatcttcgggaaaagctgcggcatagatttgcagcacttctttggcattgatgatacgtgccatgcctagcggatgttgaggctgtttctcttcgggaggcaagatttgaaccatgcacttatatccggtgtgttgccggatagcatacaacaggctatattccacatctttattttcagcgcaaagctcattgataatgatatgtttgtctcctttatatataatggttattcctttgatttcgttttcctgtctggctacaaataaataacctccactaatggcaagatcggtcataataacctgaaagtcttccgatgtgtgctgaatacagcaagcccgttcggaaagcttcttattcaaataggaatagacctcctcctgaaattctgaaacaacactgaccgctatctctttagaagggataaactcgggcaaaacgatctctttagttgaatacttgaataccgaagcatatcccatacgggcataataatcaaacaaccagggttctgccggtattaatgtgctgaagtgtactccattccgtaacatccgggcgaaagactgtgataaaagctcgcgcatgacccctttgcttcggaaatcgggatgcgtacaggctcctgaaatataggaggtctgtacagtctctccaccaaaagtcatcggataaggaagcatctgaagcgcagagattacctcatcgccactttggatggcgacattcacctctgttttatagcgcagtctgaagtacatttcaacgaattcttcactatcgtcaaaacagattttccacaatgcttttacttgctcctttatcatcatatttataatggatttaccattttaccatattcatgggatgctctttgaggcaagccatatatttttccagaatcgttgccggctggtaagacagtttggctttgcgtaaaccctcaatacctaaatcctcttcccggttgatatagatatattgttcgggaatccggttggcaaattcataattaatcatggcatacgcaccttcaatactggtatccgctttttctacatgtacgccgaatgtttcatgattgataggcataccgaatgtgaatgcgacaattttaccgttcacatgcaagatacctcccgtcagtccgagtgcctcgaagttgtggagagcataaatcagggcgcgacgttcgttgcctgtcccctcctgttggtcacagttattcactttacaccactctgcttccagatccagacattcctgaatacggtccggggtaatcggtgtgtattcgtaatccggataagtgttgcggaaccggttgatatgatttcttttcgcttggaatttcttccctttcagcgtagatagatcacttctcaaataaatataatccgcatagtcgcggtcttctgtgaaagtgaactgttccggaaggatagcttcgagatcagcgcgcatattgctgcacactcccagcatacagaaatgctggttctctttgcgggcatcttctatcagttcccacaatactgctttcaaatctcctgtgcctacgggcatcatataagcaagttgttctcccgcccagaacttgaataccaaaaagttgtcgaccactgcgaattgagtgtcatataagaacctccaactgcaaagattggagaatgaaagatcgcaattgcggcgatcacttttcatcgtgaatgaggtgattgtgtctttgtctgctaatgtgatatctttaaatggaatcataaaattgctttttgcgtttaactctttatataacggaaaatcaagagattttgtttttacaagacacctaataatcgaaggattgtaggtgtgagcagtgcggtgaagattccattcagtgtcagtcccagactggcgtatgctccatatttgctgctgatatccattgcggtggaagttccgacagcatgagcggctgtccccatcgaaagcccttgggcgatcggactgcctacacgcatgattttcatggtcttaaaaccacagatcgctcctaataaacctactgccacaacaactgccgccgtcagtgacggaataccgccaatggctttggttacttccatcgcaatcggagtcgtaaccgatttgggagccagagacaggattacttcttgggaagctcccatgaacttcgcaatcagcactactgaaataactccgacaatgcagcctgccagttgagacagaaggataggcagtaactgcttttttatcatttccaattgaagatataaaggtacgcctaaagcaacaacagccgggcggagccagaactcgatcaaatgtcctcctttattataggtctcgtatgagatatttgtcattttaaggaagatgattaatagggcgatggtcagcaatataggatttaataataccagtcctgttttcttctgaagcaatttggcaaagaagaaaatcccgaaggtgatagccaacaggaagaaattattctctaagaagctcatttgtctttattcgttaagttgattttatctttaaggcgcagtttctccgacagatggaaatccgtcaggtgaagtttgcgcgccagcttaatctgacgtgccagcctgaacttgcggacgatttgatgtacccatcccgtaacgacaagtacaagtgcggtactgacaatggtagctatcacaattggccagaattctgccgcaataacatcaaagtacaacataagagccacaccgggtggaacgaaaaagaatcccaagttagcaaccagaaagtcggacaatccctgtacccagtgtaacttaatccaacctaattttaaaaagagggtgagcagcagcataccgatgatgctggaggggagcttgatacccgtaagataaactattaattcacccaaagccaaacagccaaataaaatggcgcactgacgtatcataactaataacctattgattttgtttgaaaacgctgcaaaggtatgaaaaataggagtacagtgttaaatattacaatattttagacttggaagagaaaaataggcgaaattgtaatgtggatattgcaaaattgagtacttttgcaccgcaaattacaaattgtaatgaggttttataataacattcaatatatctatgctcaatttaatcaaccaaatcgtggcgcgtgcgaaagcaaatcgccaacgtattgttcttccggaaggaactgaagaacgcacattgaaagctgccaatatgattttgacagatgaagtagccgatctaattttactgggtaaaccggatgaaattaatgaacttgctacaaaatggggattgggaaacatcggtaaagctactatcattgatcctgaaacttctccgaaacacgaagaatatgcacagttgttgtgtgaacttcgtaaaaagaaggggatgactatcgaagaagcccgcaaattgacgagcgatcctttgttctatggttgtttaatgattaagagcggtgatgctgacggtcagttggctggtgcccgtaacactactggtaacgtattgcgtcctgctttgcagattatcaagaccgcgccgggaatcacttgcgtgtctggtgctatgttgcttttgactcatgctcctgaatacggaaagaatggcattctggtaatgggtgatgttgctgtaactccggttccggatgctaatcagctggcacagatagcaatttgtactgcgcagactgcgaaagccgttgccggtattgaaaatccgaaagtagctctgttgagcttttcaaccaagggttccgctaaacacgaagtagtggataaagtggtagaagctactaagattgcaaaagagatggctcctactcttgatttggatggtgaaatgcaggctgacgctgctcttgtaccggaagtgggtgctagcaaagcgccgggttctccagtagccggagaagcaaatgtgctgatcgttccaagtttggaagttggtaatatttcttataaattagttcaacgtctgggacatgctgacgctgttggtccgattcttcagggtattgcctgtccggtaaacgacttgtctcgtggttgttctatcgaagatgtatatcgcatgattgctatcacagctaatcaggccattgcagcaaaagcgaaaaaataagtattagatataaagtattaagtataaatcgacaacgacatgaagattctggtattgaactgcggaagttcatctattaaatataaattgttcgatatgaccaccaaagaggtgattgcacaaggtggtatcgaaaaaatcggtctgaaaggatcattcttgaaacttactttgccgaatggtgaaaagaaaatattggagaaagatattcctgaacatacagtaggagtagagtttatcctgaacacgctgattaatcctgaatacggcgctattaaatctttggatgagattaatgcagtaggtcaccgtatggtacacggaggcgagcgtttcagcgaatctgtattgctgaacaaggaagtgttggaagctttcgctgcttgcaatgacttggctccgcttcacaatcctgctaacttgaaaggggtaaatgcagtttctgctattcttcctaacattccgcaggtaggtgtattcgatacggctttccatcagacaatgccggattatgcttacatgtatgctattcctcacgaactgtatgaaaagtatggtgtgcgtcgttatggcttccacggaacttctcatcgttatgtgtcaaaacgtgtatgtgaattcctgggtgtaaatccggttggacagaaaattatcacttgccacattggtaacggtggttctatcgctgctatcaaagatggtaaatgtatggatactactatgggcttgactccattggaaggcttgatgatgggtactcgtagcggtgatatagatgccggtgcagtaacatttatcatggaaaaagaaggcttgaacacaaccggtgtttccaatctgttgaataagaagagtggtgtactgggtgtttcgggtgtatcaagcgatatgcgtgaactcttggctgcttgtgcagctggcaatgagaaagctatccttgctgaaaagatgtactattaccgtattaagaaatatatcggcgcttatgctgctgcattgggcggtgtagatattatcctgtttaccggtggtgtaggtgagaaccagatggaatgtcgtcgtgaagtttgtaaggatatggaattcatgggtatcgaacttgataacgaagtaaatgctaaggttcgcggtgaagaagcaatcatttctactcctgcttctaaagtgaaagtagtagtgatcccaacagatgaagaactgttgatcgcatcggatacaatggatatcctgaataagtaataattttattgctgatatacaaaaaaaagatggactcgatttcgagtccatcttttttttgtcttactttgcatatcaaatagttatatcccgtttttgatatgcgttactccgtcataattcccgtttataatcgtcccgatgaagtggatgaattattgcaaagtcttactgtacaatactttaagggttttgaggttgttgttgttgaagatggttcttccattccctgtaaaggagtagtagaccggtatgcagatcggttgaatataaaatatttctctaaacccaattccggtccgggacaaacccgtaattacggagcagaacgtagcgaaggcgaataccttattatattggattctgatgtcatccttcccgaaggctacttcgatgcggtagagaaggagctcaccacttctcctgccgatgcttttggtggccccgaccgtgcacacgattctttcactgatattcagaaggcaattaactattccatgacctctttcttcacgaccggaggtatccgtggcggaaaaaagaagatggacaaattctatccccgtagttttaatatgggagttcgccgggcagtgtacgaggctttgggaggtttttcaaagatgcgttttggggaggatattgatttcagtatccgtatctttaagaatgggtacacttgtcgtctttttcctgatgcctgggtatatcataaacgtcggactgacttgaaaaaattcttcaagcaggtgcataactccggcattgcccgtattaatctttataagaaatatccggattctctgaaactggtgcatttgcttccagccgtatttacattgggagtggcgcttctattattaggaacccccttctgcctcttcagtttcacgcctatcattctctatgcattactcgtatgcattgattctactattcagaataaaagtctgtctattggcgtttattccattgccgccgcatttatacagcttatcggctatggtacaggcttttggcgcgcatggtggcagcgttgtatcagagggaaggatgagtttgaggctttccaaaagaatttttataagtaatccattttttatttgcctattaccattcctgtttttgtttaaaaggaatgttgtctgacacccgggtctcaatacgtctgacacccgggtgtcagacaagttatactttcatggaaaaaaagtaatggatgcaatcgaagaaatttttataggctatatcttttttcatttagtggagtgcaaatcacatttcttattcttcccttaaaccccagcaatttgtcgcctatctgtttcaatgggaagataagtgtttcctgataccaaatgctgtctttacgcaggcttttctgattgtaaactacaccgattcgtccttccaaacgttcttgtagctctccgtttatgtaaagtgaggtccctttggcatctccctctacacgaacctttgtccatttttccacaggcaaacgataggaatggaagatgaattcatagccgtcgcgcgagaatgcgaatttacccgtattttgccagttcgcggtgaaaacagaatggggacctttgaataagaccgcatcgatattgggctttggatctgcgtagatttcaaattccacactatatggataaccgatttcgggtatagaggtaagaaccgagtcgttaccttgcaggataatttcctggccggaaagcgttaggtcttttctgtcatctatgctggcctgtagatttacgcccggtgcttccggtgttgtcctgcaccacgtttcgaaggtttcaaacggtatgtttcttgtgttttctcctttccaaagtttctcgctcataacctgcatggcaggaaaggtgcgtatatgtacatcctgttggctgattccatttccgacacggtcgttccatacagcaaacatggctcctaataaattagtagactgctctatcatttctccctcttgcatcattcgtggtgaccaactctcatatatccattgatgatccagaaagttatggtagtaattcacggctggtacgatatatagaaatgcatcgcatgtattaatcgctttggctccttcctgcagtgcggtttctaggtctagccagctataattccatgcattgaccgtttttcctttcagatttacgggggtatttcctttcatgtgtttcagacttccccataatcgcggattttttccatatttggtgatatacttcagatagtattcagtgaaatagcggaattgttccgcttctttgaggttgtactcatcagtgccgatatgtacgtccggtccgacaaataccgggtgatctcccgagagatattcgtcaaacaaagtatcaaggaaatcatatacctcttttttatagaggtcgagatgatccataccatattcttttttgtcggctgccagtatcggattgtaatgagtgaaagcgagtgagtgtgccggaacatcaatttctgggatgatattgattccatatcgtgcggccatttgctggaagttgcggaattcttctttggtgtaggaaccatctttggatgtgagtcccggaaaacgctcgctttccaatctgaaggcggcgtatgttttgttccagtcattatcgaaaaactcaacgaaaccattatcattcagatgtatttgcagttcattcattttatagaacgagagaatttttacgtaatcctgcaaatagtccattgtgaaaaatttcctggctacgtcaatcatcagtccgcggtgagcatactgcggataatccaatgcttttcctttcatgagtccaaaaggctggttatggatcatttgcaacagtgtgcgagttccccagaatactccttttacggtggaggcttcgatggttacatggttgcgtatatccagttcatagctttcttctcccaatgatgaaggcgattttttcactgacagatagatagaatgatttttcggttttccggaggttacctgataattccagccgaacatatcttttaagtcttttgccattatttccgcagtttctttcaacaggctttctgcttccggagcgattataatctttcctgtttccggtagtgtcagtttgccttttgccccattccaatgttgtaaggagggaatcacctgcgggatatccgtttgagcgtatactgtcattcctaatagtagtaagatggataagatgcttattctctttttcatatttattagatgtttatatattaatcttgatagcgcaaaactacgatatttggaagtaaagggattctaaaaatagacttatagcttccaaaattcattttttcagttatataggagtatctttgtgacttaatttgattaataatggaaagtaaacacaaactatccatcaaccagtgggcactggaagaccgcccacgggaaaaaatgatggagaagggagcagccgcattgagtgatgccgaactactcgctatattgattggctccggaaatacggaagaaagtgctgtcgaattgatgagacgcctgctcctgtcttgtgataacaatctgaattcattggcaaaatgggaagtgtgtgactattcctctttcaaaggtatgggacccgcaaagagcattacagtgatggcagccttggaattaggcaaacgaagaaagctgcaagaaaccaaagagagacttcgaatcacttgctcaaaagatatctatgatattttccaaccgatcatgtgtgacttggaacaggaagaattctgggtgctcctattgaaccaggcaaccaaactaattgataaggtacgtataagtactggtggcatagacggaacttataccgatgtgcgcaccattctccgggaagcattgctgcaaagagctacacaaatcgcggtggtgcataaccatccttcgggaaatattcatcccagccaaccggacaggagtttgacagagcatatccataaagcggcggaaacgatgaatatccgtctgatagatcacgtcatcgtttgtgaagacggatttttcagctttgcagatgagggcctactctaattagtaatactaccttatttaagtgagaatatcttatttattctcactcctgcattcatttttatactgcgtgggcgtcaagcctgtgtactgtttgaatgcagtactgaaataacgtaaagtagtgaaacctatctgatctgatatttcagtaaatgtcagatcggtggtttttatcagagtaatggcttgctccaacctgaatttgttgatatagtcatttgcccccatatcggtgatagccttcaacttgttgtaaagagatgttttactcattccgatctctctgcagataaaaggaatatctaaagacggattgctgatattctcggaaatgagcttgttaaactttaacaagaacgtttcatccgcctggctgaaagtactctccagcggttgagggaagttgcctatatgttgatagtgctctttcgtttgctcccggttgtatagccggttctgtataatcttaacaagagtgtctatctcaaaaggttttcccagataagcgtccgccccgattttatacccatacagtcggctctgttcatcattgcgtgccgtgagcagaatcacaagaatatgactgatgccgatattctcttttaccgctttgcacagttcgtatccattcataaccggcatcatcacatcgctcactataatatccggaacttgcttttgcgctatttcgaaagcttcccggccatcatgtgctatataaattgctttgaataaggatttcaattctttggagaggaaatctgtcaggttatgattgtcgtctaccaatagcactgtgtaattctgcgtagagaagtcgagtgtctcgggagcgttgatctcatgatctacgtccggtgtaatcaattcattgatgtaaggtttcggctggcagatgacttcgcccgactccaatcccaaaggtaagtcgaagaagaaagtggctcctcccgcttcgttgttcatggctccgattttacctttatgcaattccaccagcatcttggcgtatgaaagtccgactccgctaccgccaatttcctgcttgccttgatagaaacggatgaatactttctccatgtcttcctcttgcataccttctccctgatccaaaacggaaacacggacgtatgagtcatttttgctggtacggatagtgacggttgtgtttttaggactgtgtttcagtgcgttcgtcaataagtttgtgactacgattgtacacatacccttgtcaaataccacctcttttatgctgtcgtcgagctgataatctatttgcacttcctgggcagctccctcgtccgtaaaatcggcaccaatctcctttatccatgagttaaatggataggcttggagtttcaacttggtttctcctacttccatcttacgtacgtccagcaccatgttgataagatctttcatccgttgagcctgtttatgtatattcttcaacggtggataaatggcatctgtagaaggaagtgtctttaatatgcggcttagcggggcatatatgagtgtgagcggagttcgcagttcatggctgatattaatcagaaaacgaactttttcttcatacacattctgctcgtgttctttcatcatccatttcatcttgttttctttgcgtcgaagcagaacgaaaacaatttgtaccacaatgcctatgcaagcaatgatgcagagagaaacgaaccaccagcttctgtaccagggtggcagtacgtttaatgtgaaaagaaactggggagttgtttcatttccttcctgtgtgttacagctcaccatgatgggataacttcccggagcaagagatgggatcatcaattcagggttgtagccttcggttttaaggtctcccatttggaaatgatagactttgagccggagaatgtccgcaccataagtcatgacacggatcttaatgtttttactgttccaggggatggatatcttgtcttgattgagctgatacatcctgttctctccgtttatggtcagttcggcaaggcgtatttccggagagtcactactcttttctatttgagtgtctgcattgatacatagtaagccttttacacctcccatatagatgttgcctttgggggaaatgagacggggctcggccaagtattcattgggggaaattccatccgcttctccgaaccatacaaaacgtttggtatcggtgagccatataaagagtttctgttcagctcctatccacacttttcctttattgtcgcataacacggtatttacttcattaaataaggtggtaggaattctttcgaatttgcgggtatcagggtgataggtgtacaggccacgggtgcctgcaatccagaatacgcccttgtcatccctggatacagcattgaagaatccctgtggagcacttgcaaatatctccactgtgtcttttttacgatccagtctatatatattataaggatcgttcaggtaaatggcagtggaatcatatccaatggaactcaacaagccttttattttcacttctttggcacaagggacaggagtgagttgccgggtggaagtatggtagcggtaaggaggcgaacttaatattaagatcgaattgggagtatcccggtataagttgattggctgtccgctatagcggatgtgatgctctaatgaagggctcataatagcgaaaggacgcttctttcctgtctttttatcgaatatgaagatacctttggaaaaggcagatactaacaattcgttgggtgtgaagccggtgatggagaccatcttgtctccccaagtgtcgggatagtgcacaaatgtttctgtagaaggaatgaatttattgatacctcctccgtccatagcgatccagagttcttcggaagccggttcctgatatagttgtaataccgtactttgacttaatcctttgttgtgccctaacacaacattagtgtaagttctcatggatacttcacgaatgttgataaccccttcacgtttacttcccgcccatatatttccggcagagtcgctatgcaggcagagtattgtatttgtgggaagggaatgattatctccggagatatgttcgagtacggtaatattgccggttgtgggatcgaggatattgatacctcccccgtctgttcccatccatattttttgtttgaattcggtcatgcacaatacgatgtcactgctcaaacgggagttttgagtggtatagctggctatcaattttccctgggcggagaaacacttgacgccattgttgtaggttgacagccatattctttgttgggagtctatgatgattcctacgttgtcgttcccgtattggaaaggaaatggggttatctcgaaattcttgaggttcatttgcagtattccctgttgccagcttagacacaatatggtatcgggtttccacatttgtatggatcgtataatgaacggctcgtcggtcttgaattcccgtatgagagaaatcgtgttggtggcataagaatatttatatatcttgttgatccctccgaacagaagcccgtctgctattttgcagatcgatttggcaatgatgggctgattatttagtttggggataaagaagttgtcgtgaataagagaataacgggcgattcctgtggtggtcagtatccaggttgtctgctgattatcttcaataatttgcaggatactgtcgttaggcagggaattttcattatcaggttgtgcggtgtactttttgagttccgttccatcaaatctgattagtcctgtcggagtaccgatccagatgaatcccttttgttcggtatagatacagctgatgatagacggcattccgttttgggaaccaatcagtttaaagtcgtaatggttacctatacttattgctggaaatgtgcctacgataagaaaagccagtaagcagaaaaagtgttttatccaaatactttttttcatcagtcaagattattaaggggagattagtgaaacaaaagtatgattaattccgctaaaacaaaagaaatatttccaaaaaccgccacaaagacgttcaaaaacggaatatggatgtttttggaaacattttggcgattttatgaactcgccattctgccaatcaatctatttttgtggtgtatttcaatgccggatagtgtgggctattggcaaatggaactcaaaaaaacttttagtattaactttaatataatgttatgaagaaaatgcagattaggatgcaactggtgtgtctcttttcaatgcttttactgttcttccctgtggagctctttgctcaacagggcactatcactggtaaggtggtagacgaacgtggcgagtccgtaatcggagcaaccgttatggtgaaaggttctactgatggtaccattaccgatttggatggaaactttaaaattaacggtaaagtaggtacaacgataactgtcagctatgtgggctatgctcctttggaagtgaaaatcactaagctaacaggaaatcggttcgtgatgaaggaagactccaaaactttagatgaagtggtggtagtcggtatgggaacacagaaacgtaatactattacagcggctgtagcaacagttaatgcggatgcaatcgctacccgtcctgtgacggatgtaaccagcgccttacaaggtaatgtggctggtttgaactttgcttcggatgcttctgaaagcggtaccggtggtgaagttggcggagaaatcaaatttaatattcgcggtatcggttctattaatggtggagagccttatgtattggtggatggtgtggaacagagcttgcagaatgtaaatcctgccgatatagaaagtatcagtgtattgaaagatgcttctgcagcagccgtgtatggtgctcgtgctgcgtatggtgtggtgttagtaacgaccaagagcggtaaacaggataaagcccgggtgacttatcgcggttctgtgggtatgagtgcacctatcaacatgcccgagatgatgaactctgtagagtttgccaattataaaaatgcgtaccgttcggcaattggtgagtctccatacttctcacaggagactattgatttgatgaatcagtttttgcagaacccctatggtgaaggtctgctcggtattaccgccaatcaggagaataccggttggcgtggcggtgaatcgcagtatgccaataccgactggtttgattatttctataaaaacaaatctttgcgtcattcacacaatctaagtatctccggtggatcggacaaagtgacttattatgtcggtctgggttatacttaccagggtggtttgctggatcgtgtagaagactctctggataaatacaacgtgaataccaaatttcagatcaagccgaatgactggttgaagtttaacttcaataacaatatcacgttgaatctgatttcccgcccgctccccgatatgtctattctttatcatcagatagctcgttcgcagcctaatatggtgactgaagttcctatttccgggctttataatcttccttcatggaatgaagctttgtatctggacaatgtgggctattcgcagaaccgcatttctgatgccatgacttttgcagctactgttacgcctctgaaaggctgggacattatcggagagatgaaagttcgttttgatgtgcagaatgatgaattcttgcagaagcagccccgtaccacacggcccgacggaaccatagagaatgttaccgctccccggcagggatattcttatcccggtatcgaatattcgaattctttgtggggatcaatgactcgtggaaatcaattcaactattatttgtctcccagtgtgtcgtcttcatatacgaatcaatggggtgaccatttctttaaggcaatggccggtttccagatggaagtgcagcaaaactcaagcatgtatgcgtataaagacggagtgatgagcgatgatacattctcttttgacaatgcaaacggaaaagcctataatagtgaagcgcgtgaccattgggcaaccatgggattctatacccgtttgaactggaactaccagaatgtctattttctggaatttagcggacgttatgatggttcgtcacgtttcgcttccggcaatcgttggggatttttcccttctttctctgccggttatgacattgcccgtaccgactacttcaagcaatggagcttgcctgtttcacagttgaaagtgcgtttgtcttacggacgtttaggcaatcagaatggagccggactatatgattatctgaacttcatgacattgagaccggactattcaaatgcatggttgctttccggtgtcacttcggctactccggtacgtggtacagtcgctttaacaccttctatggtaagcccgtacattacatgggaaaaagtggataatgccaacttaggtttcgacctgactttgcttaacaatcgtttgacgattacggcggatatttaccaacgtacgaccaaagacatgattggcccggctgaagcaattcctgatattggcggtattgctgttgaccaacgtgctaaagtaaataatgcaacgctacgtaaccgtggatgggaattgtcggttaactggtctgaccagctgaagaatggtttcagttatggaatcggtttcaatatctttgactacaaagcagtggtaaccaaatacaataatccggaaggattgatttataacaaccacaccggtctggttcgtaacaaaggttattaccagggaatggatttaggtgaaatctggggatatgaagcaaatgatctgtttctcaccaaccaggaagtggatgaatatctgagaggagtagacatgtctttcttcaaaccgaataaggattggcaacgtggtgatttgaaatatatcgattcgaacggtgatggtaaaattgatccgggttcgggtacattgaaagatcacggtgatttgaaaattatcggtaatacgactcctcgttactccttcggtctgaacttacatgccggttataaaggttttgaagtttccgcattgttccagggagtcatgaaacgtgatttcccgatggctgcaagtacttatctgtttagcggtgattccaacttctttaaagaacatttggattattataatgtgtacaacccgggggcttacctgccgcgtctgacaaaacccgacagtcctgaatataatgcgaacgtaggttacaacacttcacgttatttattgaacgcagcttatatgcgactcaaaaacttgatgatttcttataacttccagcctaaactggttaagaagatgggattggagaacttgaaagtgtatttcacttgtgataatctcttcacgattgacaatttgccggacgtattcgatcctgaaaccttgaatcaggtaaatacatgggctgggggtagtaacgaaactgctccgggattgacttccccaatgaagcaaaatggtaacggaaaggtatatccgttgaataaaaactacgtatttggtattgaatttaccttttaaaccataagatatgaaaagaatatatataatggcttttgtagccgcttcaatattaccattttcatcctgttctgattttctggatagggaaccgataaccaagccggaagccggtaattttctgacaggtgctatacaggtcgaaaactatattaacggactatatatgacgttgccgtcttttagtaagttcggtttgggagttcgcagtgaagaaaagaatagtgacaatattattgcagaaaagtatgatgcccgtttgcatggacagaataaccagtttagcggagcttccgattggcagactggttatcagaacctgcgtaaagtgaactattttttccataattataaagtacccgaagcacaggaaaacgaagatgtactgtcgttgaaaggggaggcttactttttacgtgcctattggcatttcgatttattgaagaaattcggttctattccggtaatggatgctttttgggatgagaatgcgacaatcgcaggattacagattcccgcaaagacacgtaatgaggtagcccgatttattttgagtgatttggttgaggcgaagaatctgttgcattcgcgcggtaaatattccggaattcgtatcaataaagaagctgccatggttttggcaatgaatgtggcgttgtatgaaggaacttgggaaaagtatcacagcagcgatgattttgcatcttccactaacgaatcaaattatttcttgggtgaagttattaactggggaaatgaactgttcggttgtggcattgatctgtataaaaccgggcaaaatccgggagatgcttttgcggcattgttcaatagcaaagatttgtcaggaatgggcgaagtgctattgtggaggaaatattcgagtgatgaaggagtctttcatgatgtcaacggtaatctgaaggcaggtgttgtcgactcggaaggagctgccggaattactcaaagcctggtggataattatctgaatgccgatggaacatttattgatccgacaaatgagaaatttaaggattttaaggaaacatttgaaggccgtgaccctagattgattcaaacggtgatgaatgaaggtgccaaatttgcttctgccactactgcgaccccaatgcatctggaagaatatacggatgagaagaagaatactattagtcctcctaaattggcaggagatggaaacacacgttctttgacgggttatcacatccgtttgggaatagataccacctttgtaagtggtaatggtgagactgctttacctattattcgttatgccgaaggtcttttggcttatgcagaagctgctgctgaactggaaatgtggagcgatgatatagcgaataagacattgaaagcgcttcgtgaacgtgcaggagtgaaatatctggcaccggcaaaggatgctaatttcaccgatttcggttatacattgactcctgttttacaggaaatccgtcgtgaacgccgttctgaacttgctttgcaaggtttccggctggatgatctcatgcgttggaaagccgataaactgattgttggaaagcgtggtaaaggtgcttatgtaggtgatgaatctattttattcaaatcttacagtccggataatcagaaaagaatcagagagcgtctgacccttgatgataacaaatgggcggatccgatggccgggactctgccaagcggatatcaattccatgcagatagggattatctgttaccgatccctccttcagaattggaattgaacaaaaagttgaaacaaaacccgaaatggtaatcattaataatgatataataggatagattatgaagaaatatttctatagattattaccaatttgcctgtttatccttgtaatgacaggctgtaatgacaccgagacggttatctctatcggagaagcccggaatctggtggccgaaatcagtactcaaagtgctgctatcggagataatgtgacctttactgtgaaggtagatcagcaagacaatcagttggcactcgaagaagatatagacgttgttctgacttttgcaggtaagaatgtagaaggaaaggatgtccctgtatctgatgtctttgaaggctttgccggtcatctttttatgaagaaaggtgagaaacagggatttaccgaatttaaggtaaagaacgatctggctaaatatcctatatcgggtactatcaccgcttatgtcagaggatacaagatcaatgcggctgaacgtccgattgtggtatctgataaacactacaccatcttgtcattgaagaacaattcggacaatacggtgaaagagtatggctcatttattctggtcgctacggtaggagcgtcagctaaggaagatgtagtcgttcatattgatgcgggtgaagatgcggataaatatgagaatctgccgagcgaattggtggtgaaagccgggtataaaacagctgaatctgaacttatatgggtgaaaggagagaaaggaccgaatactttcacttctgtgtctatgtcttttgctaccgattctgaaattcatccggtatatggggacgagttggaaattaaggttactgatacggatgcaggtttgactccgggcaccgagttaaccaatgagcaatgggtttatacagatccggatcagatatttgtatcagccagcaataaaaaggctgtagaaaaatgggatgaggtcagagctgcgtcagcactattgataaaggagggtgatccgcatccgaatgaagcgttagctgctgaaggatggacattcctgaattcttatgagttccatccgattgatgctttgacagaaggtaccggactccccaatcagtatggtaatcgtcctccacgttttatggcggcacagaatgtggctaacacacagaaagtacaagcggttgtaaatgagaaatatgcaacgatgactcaagatggatatttgaaaatgtggtgtgcgtatgatccgggaatcagtgtgacaggggaaattacgggaacaagagattttggagtttcctccctctatgcaagtaagtttgatggtgtgcctacgggtgctgattcttgggaatccagcaatgtacgcattttgccgggcactcgtgtggaagttagaatccgtgtgcgtggaaagaaacactctttcaactcggcagtctggttccaaggaaatatcagaggtgtgcaatggtctacctatggtgaggttgatcttctggaaaatccggctaccaatgcgaatccgaatggcgcttggcagactttccactggaatgatatatccacttcatccggtgataagtataaaccgtcctcaggacagttgataatatcggatatggatgaattcgatatctattggatggaatggagagataataacgagattgctttaggtattaatggtaaagagaatgtacgcatgaggactgacggcagctataccggaatagctaatggaacggcttcatggaactcgtctacacattggccgtttacggacaaatacaatacggaagggttacatttactattgacatttgccggatgtaatgaatgggcgcttggtgacgctgcggcagaacaggctgctaaagatggtagttgggcaaacgactttaagcatatttcttatcaggaaagtaagtctagcaatgatacgccacgtatggaaatcgactggatacgtttctataagaagccaacctacgactattttggaagtggtactccaacgcgtaacaaaccaatgtattaatggttgttgaaataaagatatttaatcgaacaaacttttatatagttatgaaaaaggtttatcacttattgagcgttgcactgctgggcgcaatggcactaacctcttgcgaagaggacaagatagtgaatgaaaataacggtgaagggaacgaaaccgacaagaatctgactgattattcatttatagcttctattaaacagtccgcccctttgggtcgcagcaatttgcagaatggagtgtatacatggaataaaggagatgctgttacattatggaatcgcaacttcggagccggctatgatttctctatcaccccggggtataatgacaaccaacctgacaaatctgctgaattcacaggaaaagctgctgtagaaaatggccataagctgattgcggtatttccacggaaagaagcaaaaacatttaatgacctggctaccttttctatgccggagacatttactcagactggaaaaacagcagaactggcagctactacctatatggttgccaccggggatgtgactgataataagattcctgcattaacgttttcaccattgactgcattgatacagtttggtttgaaaaacacgtcggaccgggaactgaagattcgctatattacgctggagagtgatgatgatgtatttcccgcagagttgaagatcgacgaagacggagtgctacagagtctttcaggtatgcgtaacaaactgacacttgacatgagtggacaagcattggcgcagaatgaaacattaaacgggtatttgaatatattacctacaacctatggtgatacccggttgatgaaaagtacgaccgaactgaatattacagtaagcgttttgaataatgaagtggaacaggatattatcctgctgaaaaaagtaaaagtcaaagatttggaggataacatcggacttgatatggatgctactgccaatcagtttgcagccggcaagcattataaaatggattttgaggtagattatcgtttcagaattcctgatgagggctatatgatcgatgatgatggaaatattcatatctataataagactggattattcggatggaataaaattgcggatgaataccgtaaggcaactgttactttagaaaaagaatatatcgatgaaccggcaggggatggaataaaagtgattgatatgggtaatgaactttgggaacctattagtgcgtttggaggtgtatttgaaggtaatggtgttaccatccgcaatttgcaaatagctaataaaggttttatagctaccaatacgggaactatccggaatttgactttggaaaatgtaagtttctctgctgatatcacagagggagcaggagcattggctgccgaaagttcaacgagtgtcattcagaattgtacagtcaagggagtgactgtaaccgttataaaaccggtagtttttggtggtttgatcggtcgaaactccgaaggaagaatagaaggttgtcaagttatcagtggaactattaaccttaatttgagtggtgctggtaattctaattatggtggcttggttggtgagcattttaatggaacggctcttattataaattcgtatgtcggtgcagatgtaacaatcaagcatcctagtaactctagtggtgcatcctgtgtcggcggacttgttggctggaacaactccggtaaagtcaaaggttgttactcattagccaaacttgaggtttcttgttccggacaagtaggaggacttataggggctaatagtaacggtacggttctggcctgttatgtagccggttcaattagtggaactatctataataatactggcggtttcattgcacagaataccattaataatgctgatgctactgtgacggcttgctactcgaccacgcagataaatgtgactaataatgctggaagtaataaattgggagctttcgtcgcttcgaattcaacaggaatcaaccagtgttatttcgtaggcgagacggtgactaattctgtaggaagcggatctgtaaatggaattagtaaggtaacagctactcaactcaaggataagaaacgtcagatgaatctggcaatagaagccaaggatccagaatttggttttagctttaaagtgaatgaggatgccggaactaatatatactgtccgttgattctacagggggctgtgaaagaacctggcttcggtggatcagattttggagatggtggtgatatttaaataactgataacagaaaaaaataaatcatgaataaaatctattctttattagggatcgggctgctaagtgcagccaccctaagctcttgtaaagaagatgttttcattgaaggtggggatgaactgcaacggggagaatcacagacttatgtggctgttgcttctatccgggggtatgaaaatacggacaaagaatcgtctacacgtgccaacgtacaagatgacggtagttcctttatgtggaatgccgatgataaggttacactttggaatggaacaaatggctatgatttcacaaccataaattatgatgagagtgaaccgtctggaaatgtggaatttgcagggaatggtaactttgaagagggagctactgtttggggaatctatccgaaaaaagatgttccgacttcagggaatgttttcacttttacgttgggagatgctacgcaaagtgcccaaaaagcagagctgcagaatacgatgcacatgcttgctaaaggcacggtgaatgggactaccgtcaccaatcttaagtttgaacatttgacagctctttatcagtttaaattcaccaatcgaagaccggatgcctataaagtgacaaaggtggttgtttcggctgatgctgctattttcccaaaaacgttgacagtttcgggagaagagaaaacgtatggtgataaaagtaatagtctgactttgtctatgacaagtttggaaatggcaaagaatgaagttgcatacggttatttgagtttctttccgatagcagacatgacaaaggatacagaattaacttttactgctacgatagaaaaagtgggagattcttcctctacggaaacaatagagaaaaaaggaaagatcagtgaactttataatgccgaatcggtggtagcaggagatgaatataaatatgtggctggaaagcgatatggtatatcatttatgctggtggcagacttgggatatgaggagactgaagcgggtaagtatttagtcaagaaagaagacgggttgataaatttggcaagtgaaccgactgttatgacgaatgctgctacggtaattacattagatgctgatcttgatatgtcgactaaagaggcatgggtaccggttacggagtttaaaggtatattggacggcaatggcaagactatttccggtcttacaattgaagcaacaggaaacgatgccggtttgtttataactaataatggtatcattaaaaatttaacccttaaagatgtaacggtgaaacaagtgtcaggcgcagctggagcatttgcagcaataaataccggaacgattcagaattgcgtcattgatggaggagcgttgactgtcaatggaacagatgctaagttgggggctattaccggacataatcagactggtgcgtcaatgataaaggattgtaaggtaaaaggtaatgtggtactgactgttgccggtggtaaagtaaatgctggtggattggcaggtgtgaacggatggtggtctaaggcacaaatacaaggttcttcgattgacaaggaggtatcctttgtatatagaggtaatggtgaaggtgccatcggaggacttgtgggttggaatgttcagggaaccataactggctgttattctttgatgactattactgcatttacagctgtgaatgccggtggtctggtgggaggaaacgaaggacctgtaaccgcttcgtttgctgctagtgaaatagtggccaaagcgtccggaaatattggcggtttggtgaaaaatggtggaactttgacaggatgttattcaacttctgtgctttctggcactgcttctgttaccatttgtggaatatcaacgggatcagtgacagcaaacgaatgttattttatgtccgacggagtttcgaatccgggtggaaacttaccaacttcaactaaggtaagcgatgctgctgccctgattgataaaattgcatccatgaatcaagcgatagctggctctggttacaagtatgttgaaaatacaggaaccgacagtgccagagtacctttactcattcaaccggatgaataataactgacaggtattagtttgaatccccttatttatccttgttttgtatatgaagaggacaaatagggggattcgtatctggaatatactatctttgtgtgtcgaagacatctttgggttgattgcgacatacaacatgacattcatcgtaaaataaaactttatatgagacgaatctttgttagcttactgcttttatctctgttttttatgggctatgcccatgagccggaattttcaacagccggtttcttccggttgccggataccgggcgtgatgtgtactcgatgaatcctgcctggcgtttttataaaggaagtgcggtgggtgccgaagcaaaagaatttaacgacaaagcctggcaggtggtgtctttacctaatggtattgagtatcttcctactgaggctagtggttgcatcaattatcagggggaagtatggtatcgtaaacactttactccatccgaagcattgaaaggaaagaaactgtttctccactttgaagccattatgggtaaaagtaagatttatgtaaacggtaaattattggcagagcactttggaggctatcttcccgtatcggtagatgtgactgatgcattgaagtggggagaggacaatgtgattgcggtgtgggctgataatagcgacgatccgacctatgcgcctggaaaaccacaagatgtgttagattatgcctacttgggaggtatttatcgggattgctggctgattgcacataattatgtgtttatcacggatccgaattacgagaacgaaatagcaggaggcggactgtttattgccaccgatcgtgtatcggagcaatcgacagatattctcttgaaagcgcatatacgtaatgaagacaaacagggctttgcaggaaaaatttcctattctttagtagaccgtgcaggaaaagaagtggcatcgtcagatgtgaaactgaatatccgtaaagggactgcgacaagtcataatggaaagatgaaagtgaagcagccgcatttatggactcctgaatcaccttatctgtataatctgtgtgtgcgtatttatgataagaatggaaatgtagtagatggttatcgtcgtcgtgtcggtatccgtagtatcgaatttaagggaaaagatggcttctggctgaatggaaaaccttatggtaaacctttgatgggagctaatcggcatcaggattttgcagttgtaggaaatgcggttgccaatagtattcactggcgtgacgccaagaaactgaaagatttggggctggaagtaatccgtaatgcacattgtccgcaagatcctgcttttatggatgcttgtgatgaacttggtctgtttgttatcgtgaatactccgggatggcaattctggaataacgaacccatttttgccaaacgggtttataatgatatacgtaatatggttcgtcgtgaccgtaaccatccttgtgtatggctgtgggaaccgatcttgaatgaaacatggtatccggaagattttgccgggcgtgtgaaagggattgttgatgaggaatatccttatccgtcctgctattccggttgtgatgtgcaagccaagggctcgcaatattttccggtacagtttgcccatccgatggatctttcaaaacgtgatcctaaaattacatattttacacgcgagtggggagataatgtcgatgattggagttcgcacaattctccaagtcgcacagcccgtaactggggagaacagcctatgcttatacaggctgctcattacgcttctccttattataattacatttgctatgatggtttgtataaagagtctccctgccatgtgggcggatgcttgtggcattcgttcgatcatcagcggggataccatccggacccgttctatggtggattgatggatgtattccgtcagcctaagtattcctattatatgtttaaggcgcaacgtccggctgtcgtttccgagagtttggcagaaagcggaccgatggtttatatcgctcacgagatgacaccgttctcaagcagagatgtaacggtgtattccaactgcgatgaagttcgtttgactgtgaataaagatgggcaaacttatacctataaaaaagacaagacacgaaaaggaatgccttctccggtaataactttccccgggatatttgactttatggttgataagaagatgactcgtgaaaagcatgatgcggacgtctatttcctggcagagggactgatggatggcaaggtggtggctacacataaagtaatgcccgcccgccgtgcagaacagattcgtttgagagtagacaacgaaggaatcggactgcgtgctgatggatctgattttgttactgttgtggcagaaatcacagataagaatggaaatgtaaagcgtttgaataattattatatcaagttctttgtagaaggagagggacgtattttgggcggagctaatgtattggcaaatcctgctccggtgaaatggggcagtgctcccgtattgatccagtcgaccacgactcccggaaagattaaggtaagagccagtgttttgtttgagggatcacagatgcccgtaagcggtgaactggaactaacatcttccgctccaatgtatccattgatatttgataagaaagaagaagcgttgcctaagccatccgaatcgttctccatggacaagaagagtgatgctgaactggagttggaacgccgccgtcgtgaactgaatgaattaaaactgaaagaagtggagcaacaacagacagatttcggtgagaaagtagattaagactactcattacaacaatttactgttccggtgtgttttttagtaaccggagatagagagtaaatgatatattctttaggcacgggatacgcattccgtgcctaattttttatgtttcattttttatctctatctttgcgatacataataaataaggacgtatggaaaaaattgaaatagaagagaagattgtagctatgctaaagacagtgtacgatccggagattccggtcaatgtatacgatcttggactgatttataagattgacgtctccgatagtggagaagcggcactcgatatgacgctgacagctcccaattgtccggctgctgattttattatggaggatattcgccaaaaagtggagtcagtagaaggagtgaattccgccaccatcaatctggtcttcgaacctgaatgggataaagacatgatgagtgaagaagccaaattggaattaggttttctttaatcgttctatgtcaggcagtgctctgattttataagttgtaattcgttattagatctcgtaactggtaattaaatgaagaacatttattttctttccgatgcacatcttggttctcgtgctattgagcacgggcgtactcaagaacggcgtttggtgaacttcctcgatagtataaagcataaggcttccgccatttatctactgggagatatgttcgacttctggtatgaattccggctggtagttcctaaggggtacacccgtttcttggggaagctctccgaactaacagatatgggtgtagaggtgcatttttttataggtaatcatgacatctggtgtggagactatctcaccaaagagtgtggtgtcatcatgcatcgcgaaccattgactactgaaatctacggaaaggagttttatcttgctcatggtgacggcttgggtgatccggataagaagttcaagctacttcgttcgatgttccacagcaaaactttgcaaacgatgttttctgctattcatccccgctggagtgttgaattgggtttaacatgggctaagcacagccgacaaaaacgggcggacggaaaggaaccggattatatgggagaaaacaaggaacacttggtactatataccaaagactacttgaaaagccatcccaatatcaacttctttatttacggacatcgtcacattgaactggatttgatgttgagcgccacctcccgtgtgttgattttgggagactggattaacttcttctcttatgccgtgtttgacggagagaatctctttttggaagagtatatcgagggagagacacaggtctaattatgtttcaacaaaataaaaggtcaggcataatacggaacaaaatataaaacaagggcacaaagaagtagcagaaaaataacctgccatctttgtgcctttgtcgttagagaatcttcaatgcttattagttaaatcttcctttctgctcaaaacacccgctcgttattcggcaaagttggtgtataagcggaactcgtgtgcaggaacactgatctttttttctccctccacgggattcccattttccagatatagataccatgtaccttcaggaatagtataatcgatagatgcattggtgaaattcgcatacacatgaagttgtttcccattcacagctttcaatgtcagtgtacgtccattatcccaatcattataactgactttccaggtaaattgagaagaagcgttgaataaatcggagtgtgttgtccgtagagtgattagttttgtataaatatctaccaagcttttacgctctgtctgatattcccaaaggactggtttctttccggtacgtccattttcgtctattgaaatatcataccccatttcgccgaattgccaaagcattttcggacctggaaccgtaaagaagaatgcggcgttggatgataactgtttgagccgttcggacaggttggtttttaaggctccatttccgtattcaatctgtttataggcacaccgctcttcgtcatgactttccatatagcccacaaattgattcggacgggtggtgtcatataatccggagaaatcactattatctttccagcccatagccgactgacaataagaatggttcatattcctccaaaaatgaattccttctgtggctaaagttgtttcttcatttgcacagaaatgttccatggtaaccattgcatcttctttgacagcttttacggcttcgtagtattctttcagtactgatacacgagcagggtcggttgccgccaaatcatcatcacctgttgtctgtttctgtgtgaaacctttggtgaaatcgaaacggaaaccgtcgatgtggtaagtatctaacagatatttcaggttgcgtttgacaaaagcttttgtttgttctgaagtgtgattgaaatcatccggtgaaaaaacatacttctgatgcggtgttacagcgttcagccatggattcttagtggaagggcggttattaaacgtatcccagtacatacgggcaaacggattatcattgttcgtatggttgtagactacatcgaaaataacggcgattccattctgatggcaggcgtcaataaaagctttatattcattttgagttccatacgaggcatccagtgcaaagtatagtccggtgttgtatccccaactgtcattacctgcaaattcttgtacaggcatcagttcgatagcatctattcccagttcttttaagtaaggcagcttttccattgctcctgccagatttccactggaagtaaaatcccgcaacaagagctcatagataaccggattttctttattcttcatctcaaattctccggcactccattgatagggttgtgggtttgtgcttacgactgatacgtaaggtgcttgtgcgccagtgggaaagttggtatccactcccttttccaatgcttgctcacaataaggatcgcacaagtaagtaccgccatccgaagcactgtacacaaagtactggaactgtgtttcaccggcagtcaattcctccagagtgatccaccagcaatggtttgtttcgtcatatttcatcatgtagcgactatccagtttccagttgttgaaattacctgttacaaatacacaatctttatgaccgccctgactgtccttatcatataatacaagcattatcgaagtggccgaatggatatgaataccctctttttcttctccggatatggggagaggggctttttgcggttcttcccagataaatccgttttgactatcttctactaaagttgcgtaatcgtaggtttgttggctaccttccgcatcacgtacaatcaggttaatggtctgtaagggagtagatggagcaacagaatagaaatggcggatagatgaggaaagggtgatactccacacattgtcctttgtctttttcagtctgtatttattctgattatctccccatgtaggtgcacctgtccagtttgctcctgttccggagtgtaagtacaagtcgtcagcgtaaccatagaagttacttccttcgggtgctttgaaggtgatagtcagtggttcatccgctttaggaatagccggatcaaaattaaatccgtcgtggagaacttgttcttccggggcaggatcagttccggacgaaggacgctcgcccggcatcaacggatcatcatctgaacaagctccaaagctgttgagtatcagcaataaaaggagccaaatatatttaaagtctttcataagccttattttagaattcttcttccaatgtagtggtactatatttagctttgagtgtgtcagatttcgatcatatctcaaatctcctctttcccgaagagggagacttgagatatgatcgtaattgattctactcgttgtgctgtttaagagtgtctgatagttattcgactttacctttgcctgtcgtaaagttaatatggactttctgaccggcttttacattacattcgtagccaagttcgcttagattatccgatacgttcttattctcacggtaaacgatagtaccatcgccttcattagccagatcaagtgtaaattcgctcttccaccagcctccggcatctacagccgtagtagaaatacgtgccatgcctgtaacggttgctgccggtgatatgaagtcgcttgttttatcggtcggaatcctgaacaaggtcgtttcatcgcaattccacgaattgttaatcacacctcccaacaggtaaacttccggcaaacggaatgaaattgtttttccttctgtagtcactgcgacaattaccagataccatccggatttaccaatgccaatattgcctcctgaggatgttaattcggcgaaatcaattgcttccggagataagatttcttcgtcataaccaaagtctccttcccattttctaaccggagcaaacttgatttggtctcccgccgtataatattgtatactccagaacattccgggagtctgtgtgacaggaaccatttcaggagctactgcccaatcccacccaagactgtacggagatccattgatgtacatgtgctcgggtagatcctccttgattgtgtatgtataatcttctacattaatcgtaattttcattttctttccgccggcgcaggtgagattatccgggtcggctccttctttatccctgaaagccaataatcccggatccggatcttctattactttggaagcacccaaggctctttgccaggcatccggagcttctatcgcacttcccgggacaatcttgaaatcaaacttctcttccgactcgacgactactgaaaagagatactgattgtctttgtctacttcgagctttgtggctgtcgatttgtccatctgccagctgtttagatcacctactatatagtattccgtatccacagccggagttgcgaccggagtgatggcagattgcatttccgggtattcagtcagtgaagttgcttcaccgttggttgtcatgactaccggtgtcagctttaaagtgacttcgcgctctaaagatttttgtgacttatacaaacttgccactttttggtcaagttctgtcaacctgacttttatattcccatcttttacttttgacggtagatttaatatctgcccttcggcaactaattctatattacaagctgtgagtgagaagttttctgcaatcgaagaaacagaggcgattaccacagaatcgcccggctgttcttcaagtttcatactggcaaccggagttatatctaccattgcagttatagcttcttcctggggattggactggggatcagcccagtccttaaaatcttcatcgcaagcggtgaaagctgccgaagcaagcaacagacacgccatatatgataatcttttcatgatattcagttattaaagttaacgattattgagtaacggaacctgttttctgaacaaagttcagatttattttctgccctgccttaacgtttatcgcatattcaggacctatttccgaccaactgtcaatcacacttttgttttcacggaacacgatttttccattaggtatagcgaactccgtacgccaccagtcttctcccggaactttgacggacatacgcaattctccgcctccggtgcataccggtgaaacaaagtctgcatctgccgttgttggtgcttggaatttgcctttatcgccgaatgtccaatctcctatagcattgcctatcagacaaacttcgcccggagcaatatccagcgtaaaggcataatcagtccctttgatgcttacagacatgatcactgtataccagcctgtgacattaacgctgatattttgtccgccaaatccatcatccgatccggtgaatgcatccgaggctattgtcagacgtggatcgttgaatccgatgtattctccttctttagtaccgaacttgaacatatcagtgcctccgaaatagaataaaccgaagaacttggacattccgtttactgctgccaaaggcacccagttgctccaattactacctgccatcgagccattgataaatatactggaaggtaattcgagaggcggtacagctttatatcccaatactttgggaagttcaattacattcgaaaaagcgatgccacgaccactattggtcagttccgctttcaggcgtacataaacgggtatgggagtggtcggaaattcttcatcggaggatgcactccacaagtctcccagtgccaatgcaaattctaaagctttcacttccattttggcagaagaatgggtagtacccaaagttgtataattagcttccgtatttgtctctgcatgagcgtcaacgaaaatttcttccagtgaaatttgtactgaataagtggttgccatcggaatcccgtaatccggttgtgtacaggttaattccaatgattcggagtttttaaggtcgtacacgttgttggaagcaaaagctggcacattcagtacgaacgtatccggttcgttcaacacagggttgctgtcacggtctgcttcacaggcggacagagctagtagccccattgtcaatgtaaatagtttatataggtttttcattgttttcagtctttaaaacgtgaataaaggttctatcaatatcccggattctgagtcatatttgtattcgtcagcgtttctgttttcggtatcggatagagattatagatcgaactcacaccgtttccttcaaaggaaccgcctttccaatcccagaggtaggtgcttgaggtgaaatagccataacggatcaaatctgtgcgtctgaatccttccagatacaattcgcgggcacgttcatccagaatataatctaatgtcaggttattggcagagggtatttctgttgctttggcacggtctctgagggctttgatatccaaccaggcattttgttgtgcatttgcgccgcctgctctcaaataggcttccgcgcgaatcagataagcttccgccaaacggaagaacggaatgtccgtatcaggaattttagcatcgtgagcgggttgtccgtccgagcgcagattactccatttcataaatgaaagtccgtcggtgaatttacctacactttccagttcggctttgcgaccggttgtatagaacaaggcgcgttcatcttttgcagcagcctgcacatctctcacattctgccatttattatcggtatattcggtgaaaggaatatcctcactgtttgcgaagaacttgtcaaccagtgctttgcgtgtacggatacattcccaagggtcatttgttccgcgattcggcatgtcgctcttttgcgttgcagcaatcaggaagtaacttcctccgtaactctttgcttgtacaccatcctgacggatagaaaggatgatttcttttttagcatcgggattttcatcattgtctgccataaaaagttgttcgtaatttccacacaatccgtatccattggagggatcgagcactttgccggcataggtgatagcatcattccaacgcggttgtccggtgtatacttcggcattgagatacaaacgggcacgcagcaaccagcaagcagctttgtcggcacgtccgaaaggagcttgacgcggttcgctcatatcattttcgatgctttccagttcgctttcaatataagcgaacagttcggaggccgtcttttgaggaggattctctttggagaagtgttcggtgaaaggagcttttccgaaggtgtccatcagataatagtaaaataaggaacggagaaaacgggcttcggcacgttgctgaacggaggtagcatcctcttttccggcgatctgatccaggaagaaattgcagagtgtgatattatatgctaaacgattatataatatttctgtctgctgatgagaggagttccaacgcatataagttagttcggggataccggcattttcttgccaggtccatatcatctcatcagtgccatattcattgttagtgaaaagagcgcgatagaaacaggattgaccttcgtcctttactgcgatatccggatcttcgctcaatttttgtccggtaagtcccagtgaagcgtatagtttggtaaagtacatatcttggtcgaaggtggcagtcatctgaggatcgattggagatatatccaggtcattgatacaggaggtaattccggtggtcaggctaaggaacaacgctgctgaaactattgattttatatatttgaacttcataatagtctactttttaataaattacaatcttagaactgaagacttagcccgaacaggatagtgatcggatgaggataaatgttcctgtcaatacctgctactccggcatcatttcctgaactgataaccgattcaggatcgagtcctgtatacttggtgataacgaagggattctgtacagtaccgtaaatacggccgttgatacctttataagcctgggacttcagtaaatttttgaagctataacctactgttatgttatcacaacgcaagaatgaagcattctcaacgaaacgatcggacagataatagtctccctttccttcaaatcccagattcacggcagctgtcgggcggttggaatagtatccatgattaaagattcctcccttaccgacactggatttactggccagtacgtcattgtacacatagttattcaggctggcacggagggcaaagcttaaatcccaatttttataagtgaatttggaagtcagtcccatcaatacgtcagcggcaggttttttatagatatatttgtccgaagcgttgatgacaccatctccgttacggtctacgaacatgttttcaatcggttttccatccttatcatacacttgttggtaaacgaagaatgagttcatcggataacctactttctgtacctggcaggttgcaccgctaataccagtagatacacctccggtttctacatagtaattagaatcatctcctccggtcagtttagtgatttcatttttgttccaagtgatgttatatcccaagtcccagacaaaatctttggttacaataggtttggcattgatggtgaattcaagccccgtattttttaatgaaccgatgttgctgatcagttgggtattaaagttagtccccgccgcaatctttacggtattgattaaatcgtcggttttccggtaatagtaatccatcgagccggagatacgtccgttcaggaaagcaaagtcgaaacctgcgttataagtcgttgtctcttcccatttcaggtcttcgttataagctttaggacgcatagtgccataataggtatccccgaaaggataataacctccggctgcgttgacgcggtacagtgccatataagggaaatcataatcgtcgccaaagttctgctgacccgtgataccccatccgaggcggagtttcagatctgacaatacttctacgtttttcaggaaattttcttctttcagtttccatcccaaagcaacagaagggaagctactccaacggttgtctttagagaaacgggaagaaccgtcctggcggaaagtggctgtcagcaaataacggctaagtaatgtataatttacgcgggcaaaataagaaactaatgtactgtgatgtccccaggctgtttgtgagcgcagattcggattgtaggcttcgcctgttaacggatttgttccttgtccgactttatatccggtatagtggaaatgttgctcttcaccacccagtattacgtcgacataatgatccccgatttctttggaatattgtgcataggcattcaccgacaggttatatttgtagccgtagtcagtcccgttccaaccatagtaataagagcccggggcataaggtgaatttacattcttttccttaccttccgagtagtcaccgcctacgttagcatggatatgcaggtcagggaggaagtggaatttatagtctacttctacattgctgataaaactggtgtttctggaagtatgtttctttagtttcagtagggaaacagggttggcggttgaattactttccagtgtaagcggccattccggatcgttatatgaactaccgtcactggtcggttggtagaatccaccgaagtttttgtacatgtccgaagagtcatatacaggttgggtcgggtccatggtcaaagctgcgccgatagccccgtcgtcagcataacgttggttggcccacatcattttagcattgatattgaacttcaggtgatctttaaagaaagagggtgtcagattgacggaggcggtataacgctcgaaattagatgtcatcaggatcccattctgattggtgtaaccgaaagaaacacgataaggcatatttttcaaaccaccgcttacagtcacgttatggtctgtactaacggctgtctggaaaatttctttctgccagtcagtgtttgcttcaccgaaggggcttggagcatttccttcaccataaagtttggatacgtatcctttgaattcattggcatccattacgtctattgtcttttgcagtataccggcggaaacgttaccttcatagttcacctgtggtttgctgcctgctttccctttctttgtagtgatgataatcacaccattagaagcacgtgaaccatagatggcggtggccgaagcatctttcaaaacagtgaaagtttcgatgtcattcggatttaccattgccaaaggattagtcaaaccttgcacaccgctattatccattgccagtccgtcgataacgatcaacggatcgtttttggcgttcaatgatgaaccaccgcgaatacgaatcgtagctcctccacccggagtaccgctggaaattacattcacaccggctattttacctgttatcatatcctgtgcgctggtggttactcctttgctgattttatccggcttgatggcagtaactgatcccgtcaagtcgtttttctttactgttccgtaacctacaacgactacggcgtccaatacttgagagtcatcttccagtgtgaccattaccgaaggagctgctttaatttctgctgctttgtaaccgacgaatgtaatggacagaatagaattttgaggaacattcaatgtgaagttaccgtcaaagtcagtgatggtacccgttgtggtacccttggcaatgacattggcgccaatcacgggttcgcccatagcatctttcacatgtcctttgactgtgatttgctgtgcataagcgcccaatgataaaaacatccctattaacaaggggagaatcgtttgaacgattctaaatttaacttgcttcatgcatttaaaaaattaaagttaacaatatagtaatattatttctctctcttaaaagtttctttaaaaatacctattgaaaacactttttttaagactatcctttatttatagtcttttcaatcccttaacctctgatttgtttttcacctctttgatactgattgcgtatccaccgccattggcagcgtgcagattcagtttgcttttattattcaagataccttttttgatggtgtatgcctgcgggttatctttccagtcggcatctttggcatctgcgtatacggtagcgacgtattgttttcccggttccaggaaatcgaacgttaattgggagtcgtggccgttttcaccggctgtgcagcctatgtaccagtcgtccgttccttttgctttgcgggcaattgtgatgtattctcccggttctgcttccagatagattgttttgtcccagtcgagagcgacgtctttgataaactggaaagcatccataaagcgttcgtagttttccggaatatcggcagccatctgcaaagggctatacatggtgacatacaatgccagttggcgtgcaatggttgaacgtacctgggagttgtttgccggattcatctggttacagtgagtctcgaagatgccgggagtgtaatccatcggaccaccgaccaggcgtgtgaaaggcagaatcgtcgtgtggtatactttatttcctccaaatgattcatattctgttccacgtgcggattcattaccgatcagattgggatatgtacggcagataccggttggacgggttgcttcgtgtgcattgaccatgattttataatcggcggcttttttcacggcatacaggtaatgattattcatccattgaccgtaatgatgttctccgcgtggaatgatattacccacataaccgcttttaaccgagttatatccattgtctaccatgaattggtaagctttatccaggtgacgttcgtagttgcgaacagatgcagaagtctcatggtgcatcatcattttaattcctttgcttgcagcataacgatggatttcctgtacgtcgaaatcaggatatgcagtcaggaagtcaaatacatagtctttgctgttgccgaaccagtcttcccatccttcattccaaccttctaccagcactgcatcaaatccgttggctgcggcaaagtcgatgtaacgtttcacgttagctgtattggcagaatgtttgccgttcggtttggttttggagtagtctgtaacgccaagtttcacgctggtcagttcatctgtataagcccaggaaccttttccggtaatcatgtcccaccatacgcctatatatttcaccggtttaatccaggaggcggcgtctgcaatcttacaaggttcgttcaggttgagggtgatgcgggaggcgagaatgttacgtgcatcatcactgacgatgatcgtacgccacggagagttgcacggagtctgcatgtaacctttatccccttttgcatccggtgtcagccaggattcgaatatcatgtttttgtcgtccagattgaggtgcatacaagaataatcaatcaaagcggcttcgtgcagattgatgtataaaccatcatctgttttcatcatcagtgccgtctgtacacctgtcggtgaaaatggggtttgagaagaatttggagtgatcgcctgttgcatcaaacctctgatttccgatagacgggagatggtgtagtcgtactcttgagtgtcgtaatcgcccggtatccagtatgcgatatggttgcctgccatggcaaattgggaatgttcttccttgataacgaagtagttcagtgatttctgttgcggaaattcataacggaatcccaaaccatcattgaacaggcggaagcgaacaacgatggaacggtcgttcattggctgaaacagaatgactgccagttcgttatactgattgcggatttccttttcttctccccagactggttgccaggtttcgtcaaaggtagtcgtttgcgcatctttcagcttgaagccattataaagattggatttagaatcgagcttggtgaggtctctgcggtctacccagtcaaagtcggttctggtattatcttcttttttcaattccagtccgagagtgctcggcttaattaccaccttgcctttgtaagtcaagtcgtaggttggtgcgccttctttgttaacctgaaaggtcagaaccagattgccatccggtgaggtcagtttctgttgtgcattcgcaatgaatgagatgcaaaggaatgcgatgatcgaaaaaaactttttctttttcattctatttatggtattaaattgtaagctaaccgatatttctattcctgtttgtttcggatattgcaaatgtagcaaccaccttcacttttttgcttgattagaataaaaatacaagtttgtataaatgctagtatcttgttttataattgtttatctatctgatttcattggataaatataagtcgtagtgaacttgcttagaaggctaaaaggtatatcccacggcttggaagtgttaattcatttcttaattcaatctttttgtctgtgagcaaatcatgagcagacgaggtggagagtatttcctgataaggatgtaagtcaatagtctgttcccggtcgtttccattcagaaagacaacgactgattggttaccgtatttgcgttcataaacataaatgcctttattgggtgcgaaatgttttagtttgcctttggcgatgacttcatttccttttctccattggagcagtttttgcataaaagagaaggcttcattttgttgcggagtacggttggttgcttcaaaacagtttttggcgtcattctgccaacctcccggaaagtcacatcggagtaatccgtctccatttgctttgtcggctgccatcaggatttcagttccataatatatttgtggaattccacgggtagtcagtaagaatgtcaaggcttgtttatatcggttcaggttcttggtatcttcctccgaacggtagaaacgggaagtatcgtgattatcgaggaaggtcagcagactcattggatcggcgtagacaatatcctgtgagaggtattcgtagagtctgaaaagtcctccgttccattcggtggtttcttcgtcgaaagctttatttatttcttccatcagtgggaaatccatgacagtaggaagataactgtttttcggataagcaagtttactgtctttctgccagtaggagatcagtacattgctgcccagccatgtctcaccgacaatgttgaatgaaggatattcatcattgaccgctttgcaccaatgcgccatcatttcaaagtcggcgtaaggatgtgtatcctggcggattccgttgatacccgcatattctatccaccagatactactctgtatcaggtaagtggctacgtgacggtttcgttggttgaagtccggcatagtcagtgtgaaccaaccgtcaatggccagctttttatcataatcggaagtataagggtccatttgggtggcagttttgaaactggtctgcatgtagtttccctcaaagttgaaccaatctttggcaggcatgtctttgaatagataattgttcgaaccgcaatggttgaagatcatgtccatgactacctttagccctttagcattggcttcttttacgagattgcgaaactcttcattgcttccgaggcgacggtctacttgatagtaatcggtgatggcatatccatgataagagccttccttcatgtcattttcctgaatcgggttaagccatatactcgtaactccgaggtctgcaatataatccaaatgtttctctattccttttaaatcaccgccatgacgggcgaaaggttcgttgcggtctatgtttgcttccaacattccgggaattatatcattggaggggttgccgttggcaaagcggtccggcataatgagataaagtacatcactggagttgaagccttctactgctgaagcattctctttgcgctgtttaagttcgtatggtattttagtctgttttttaccttgtttcaggagaatgtcgaagtgctgagggatagcttttgaaagatctaaatataagatcagataattaggattttcctgtttcaccacgtcctgcagggtgatgtcattagaagaaatacttacctctgcggatgatatgccatcgccgtatagaagtatttgtagttcgggattcttcattcctgcccaccaaaaggtaggagccactttctttatattggttgcggcgaatgcttgatgataacccgatagaagtaatagtaaaatagcaaataacaaatttcgtttcatggtagctagatttttaactgtttgctcggagaaccgatgatgcaaatgtagggggatgctgtgcacctttgtgagattagaatggaaatataaacctgttatctgactatgttgctgataattagttggatattctaataccttatgccgaaaaatacaagtgaaaatgaaaatagttatacccatatttttcgttttcattactatatttcttatatttgtaacatctttaaaaaggaaccttatgaaaaatctaaccctttatatgctatttcttcttttgctctttcctttttcgttgtgtgcaatgcatacggataatgcggctgctcttaaaaagctggatgaagttataagcaagaaagagactttccagattcggaaagagaaagagattaataacttgaaattagaacttgcccattctactgatcctgttcgaaaatatgaattatatgcctctctttttggtgcttatttgcattatcaggcagactcgtccttatattatattaaccgtgagatggaaatccttccattgttgaaccgcccggaattggagtatgagatcatcattaatcgtgctacggtaatgggagtaatgggaatgtatatagaagccattgaacagttggagaggattgatcctaaaaaattgaatgagtggactcggttatcttattatcagacgtatcgtgcctgctacgggtggttagcagattatacgaccaataagaatgaaaaagaaaagtatttgaagaaaaccgatttatatagagattccattattgctgcgatgcctccagaggcaaacaaaacgattgttttagccgaaaaatgcataatgaacgggaaagccgatgtcgctgtggatatgctgaacaatgctttgaaagaaattcaggatgaacgtcagaaagtatatatttattatactctttccgaagcttatagtatgaagaaagatatcgaaaaagaagtttactatctgattctgactgccattgcggatctggaaactccggtgagggagtatgcttcattgcagaaactcgcgcatctgatgtatgaatcaggagatattgaccgtgcctacaaatacttgagttgctcgatggaagatgctgtggcgtgtaatgcccgtttgcggtttattgaggtgacggagttttttccgattatcgacaaggcgtataaattaaaagaagaaaaagaacgtgccgtttcccgcgctatgttgattagtgtcagtttgttgtctttgtttcttctgattgctattttctatctatatcgttggatgaagaagttgtctgttatgcggcggaatcttagtctggctaacaaacaaatgtctgcggtcaacgcggaactggagcaaaccggaaaaataaaagaagtctatatcgcccgctatctggacagatgtgtcaactatctcgacaaactggaaacttatcgtcgttcattggcaaaattggcaatggcatcgcgtatcgaagatttgtttaaagctatcaagtccgaacagtttatccgggatgagcgggatgaattctataatgagttcgacaggtcttttctgaaacttttcccgaactttatttcagctttcaataatttgctggtagaagaaggaagagtgtatcctaaatccgatgaacttctgacaacagaacttcgtatctttgcccttatccgtctgggagtagtagacagtaacaagattgctcattttctcggttattctttggcaactatctataattatcgtagccggatgcgtaataaagctgccggagataaagatatgttcgagcagaatgtaatgaacctataatgttattcacagatagcaatatgttattacttcgtaatatacgagccaataatgcttgtgtataaagcaaatatctacttttagtgttcaataatccactgtgcatctctcttttttttctacctttgtagacaactaatctaaaataaatatactagaaaatgaaaaagttagtctacacactgttctttgtccttatctccgttgtagccaacgggcaggcaaagtacgtattctatttcatcggagatggaatgggagtcaatcaagtaaatggtacggagatgtatcaggcggaaattcaaaatggtcgtattggagtcgagcctttgttatttactcaatttccggttgctaccgtagcaaccactttctctgctaaaaattcagtaacagactctgcagctgcaggtactgcattggcaacaggaaagaaaacttataatggcgctatttctgtaggagaagataaaaatgctattcagactgtcgcagaaaaagcaaagaaagcaggaaaaaaggtgggcgtaacgacttctgtcagtgtggatcatgctactcctgccgcattttatgcacatcaacccgatcgtaatatgaattatgaaattgctcttgatttgccgaaagccaatttcgatttttatgcaggcggtggtttcttgaaacctaccaccacttatgacaagaaagaagctccgagcattttccctatttttgaagaggcaggatatacagtagcacgtggttacaatgactataaggcaaaagctgcaaaagcagaaaagatgatcttgattcaggaagagggagccaatccttcttgtctgccttatgctattgaccgcaaagagaatgatttgacattagcacaaattacggaaagtgctattgactttcttactaaaggcaataataaaggctttttcctgatggtagaaggaggtaaaatagactgggcatgccacgctaatgacgccgctactgtgttcaacgaagtgaaagacatggataatgccatcaaagtagcttatgaattctataagaaacatccgaaagaaacgctgattgtgattaccgcagaccatgaaacaggtggtatcgtgctcggtacgggaaaatatgcgttgaacctgaaagcattgcaatatcagaaacattctgctgacggactttcacaacgtatcagtgaattgagaaaatcaaaaggcaataaagtcacttgggaggacatgaaaacattcctcggcgaagaaatgggcttctggaaacaattccctctttcttgggaacaggaaaagacgttgcgtgatgaatttgagaaatcattcgtgaagaataaagtcgtatttgctgaaagtatgtactctaagagcgaaccgatggctgcacgtgcaaaggaagtgatggatgaaatcgctatgataggttgggtaagtggcgggcactctgccggttatgttcctgtatttgctattggtgcaggttctcaactgtttggtgagaagattgacaatacagaaattcctaaaagaattgcgaaagctgcaggatataaataatagaactgtatgaatataaaaatagccggaagtccttggaatcccggctatttttatatgtttttgcaaattatgctttcacacgtcctacgtaagaaccgtcacgagtatcgatttcgattgtttcaccctcgctgatgaacaaaggaacacgtactgttgcacctgattccacagttgcaggtttcagtgtgttagtagctgtatcacctttcatgcccggttctgtataagtcaccttcatctgaaccttgatcggcatgtctgcataaagtacagtttcagtagaagcatcagaaacaacttccaatactgaaccttcgagcaggaagtcaacaccattaatcagatcgtgagcgataggatgttggtcgaatgtttcctggttcataaagatataatcttctccttctttatacaaaaattggtatggacgacgttctacacgtacatcttccaacttttcaccgatgttgaaacggcgttcgagaacgtatccgctaactacatctttcagtttagtacgcataaaagtgttacctttacctggttttacatgcaggaattctacacagaaatagagctttccgtccatacggatacaagttccgtttttgatgtcttgagcattaatcatactgctatttttcttattatattattgttatttaattgttttcgcaggaattcgactgcaaaagtaatctaaatcggtaaaaaacacaaaaacttttgagcaaaaatgagttatctcttggttaatttaaaaaaagtgcctatttttgcagcccgattacgtagaataataacataaaaacaagatacagtaatgaaaagaacatttcaaccctctaacagaaagagaaagaacaaacacggtttccgtgagagaatggcatcggctaatggtcgtagagtattagctgctcgtcgtgcgaaaggcagaaagaaactgactgtttctgatgagtacaacggacaaaagtgataatcacttgtcatcaggaaacaaaaaaggcggagaatttaatcttcgccttttttgtttctctgtttttcaaggggatagtatgttaaaaagcggtattgtttgctcttatttatgactttttgcttttctttgtgagattaaataaaactcataaacgaacatacgcgatggtagagtatatccgggacatgaaaccccgtatcattataataaggttgttgaaatctataggagtggggattatagttgcagcaattctggcgatgataagcgtctttgcataataggtagggacatttttcatcgcctactttttaaaagttcaactattttgtcgtatctttggcgcatattaacagcaatgcgtatgactattaaagaattcttttcttttaaaaccaataaatatttctgggtgaatattatcgccatgattgtggtgatggtagtgatgatatttggtgtgttgaaatggcttgatatacatacacatcatggtgaaagcgtggtagttcccgatgtgaagggaatgacagtggaagaagctacgaagatgttccggaatcacggtttggtatatgtgatttctgataccaaatatgtcaaagataaagcagcgggtatcattcttgaactgaaaccgggagccggtgaaaaagtgaaggaaggacgtacagtatacctgacagtcaataccctggatgtccctttacgtgccattcccgatgtggcggacaacagctcgctccgccaggcacaggccaagttactgaatgccggttttaaactgaatcagattcaattggtaaatggtgagaaagactgggtgtacggcgtgaagtatcagggacgtcagttggctgccggagaaaagattcctttgggagcttctttgacattgatggtgggagacggctccggtgatatgtcggaagaagaggactcggttgatgtttccgtggatacggagaaaccggttacgtcggaatcatcacctgctcaagatgatagttggttttaatagataaataacagaaacggactcgcatgatagaggaagaacttccggatgaactggagaatgatttggatgatatagaacctgtcggtgacgaatcccagctttacgaacacttccgcgtggttgtagacaagggacaggcgatggtcagagtcgacaaatatctgttcgaacgtattgtcaatgcttcgcgcaaccgtattcagaaggctgccgaagacggattcgttatggctaatggcaaaccggtgaagagtagctacaaagtgaaaccgctggatgtcattacggtaatgatggaccgtccccgttatgaaaatgaaattattcctgaaaatattccccttactatcgtttatgaagacccttatctgatggttgtgaataaaccggcgggattggtcgtgcatccgggacacggaaactatcacggcacgctggtcaatgcgctggcctggcacatgaaggatataccggattatgatgccaatgacccgcacgtgggacttgttcatcgcatcgataaagatacttcaggcttactggtgattgccaagacaccggatgccaaaacaaatctgggaattcaattttttaataagactaccaaacgcaaatatcgtgctttggtgtggggtgttatggaacaggatgaaggaacgattgtcggtaatattgcccgtaatccgagagaccggatgcaaatggcggtgatgtccgatccgacagtgggcaaacatgccgttacacactaccgcgtactggaaagactgggatacgtaacccttgtggaatgtatacttgaaacaggacgtactcatcagattcgtgtccacatgaaacatatcggtcatgtgctgttcaatgacgaacgctatggcggtcatgagatattgaaaggaacccattttagtaaatacaaacagtttgtaaataattgctttgacacttgtccccgacaggctttgcatgctatgacattggggtttgtgcatcccgtcacaggtgaagagatgtattttacttccgaacttccggatgacatgacccggcttatcgagaagtggagaggctatataagtaatagagaattagaatgaaacgcaacatcgctatcgtagcaggaggagatacctctgaaatcgtagtttccctgcgtagcgcacagggtatttattcctttattgataaggaaaagtataatttgtatatcgtggagatggaaggccgtcgctgggaagtacaattaccggacggaaacaaagtgccggtggatagaaacgactttagttttacgaacggaacggagaaggttgtgttcgactttgcttatatcaccatccacggtacgccgggtgaggatggcaggctgcaaggctattttgatatgatgcgtattccgtattcctgttgtggagtgttggcggctgccattacttatgacaagtttacctgcaatcaatatctgaaggcttttggagtgcgcattgccgaatcattgttgttgcgccaaggacaatcggtttctgacgaggaagtagtggaaaagattggcctgccttgttttatcaagcctagtctgggaggttcgagtttcggagttacgaaagtgaagacaaaagaacaaatacaaccggccattgttaaagctttcggagaagcggaagaggtgattgttgaagcgtttatggacggaacggaactgacttgcggctgttataagacaaaagagaagtcggtcatctttccacctacggaagtagtgacgcacaatgagttctttgattatgatgctaaatataatggacaggtagatgaaatcactcctgcgcgtatctcggatgaattgaccaaacgcgtacagatgctgacttcagctatctatgatatattaggttgttccggcattatccgtgtagattacattataactgccggtgaaaaactgaatcttctcgaagtaaatactactccgggaatgactactaccagttttattccccagcaagtgcgtgcagccggactggatataaaggatgtgatgactgatattattgaaaacaagttttaagtattaagtatcaagtataaagtattaaccatgcggtttgtacgcagtctaatactttatacttattacttaatacttgagcacataatacttgagacttatggatctgacagagtttaatgaaattcgtccttacaatgatgaggaacttcctcaaatctttgaggaactgattgccgatccggcttttcagaaagctgctaccggtgctataccgaacgttccatttgaacttctggcgcaaaaaatgcgtgcctgtaagactaagcttgattttcaggaggcattttgttatggcattttgtggaagatagcggcagatcatactgccggactgacactggatcataccgccataccggataaaagtaaagcttatacgtatatatcgaatcatagagatattattcttgattcgggctttctctctattttgttgattgaccagggaatggatacggtagaaattgcgattggcgacaatttgcttatttatccctggattaagaaactggtgcgtgtcaataaatcatttattgtacagcgggcgttgaccatgcggcaaatgttggaatcttcagcgcgtatgtcccgttatatgcattacaccatttcagagaagaatcagtctatttggattgcgcagcgtgaaggacgtgcaaaagattcgaatgaccgtacacaagacagtgtattgaaaatgttggcaatgggaggtgaaggcgatttgatagaccgcctgatggaaatgaatattgctccgcttgctatttcatacgaatatgatccgtgtgattttctgaaagcgcaagagtttcagttgaagagagacatcgaaggatataaaaagacgacacaagacgatttgattaatatgcagacagggcttttcggatataaaggcagggtacattttcaggttgctccttgtttgaatgatgacttgcaaggcttggaccgttcgttgccgaaaccggatttgtttgcccgtatttctgcctgtcttgatcgccgcatccatcgtaattaccggatatatccgggaaattatgtggcgtatgattggctgaatggcacaacggaattcgtgtccaattacacggaagaagagaaacagcagtttatgaactatattgaacaacaattggcaaagatcaagattccgaataaggatgaagactttttgcgtgagaagttgttattaatgtattccaatccgttagttaattatttagcagcttgccgatgaaaagaagaaaattacatgttgtttggttgtggggattgcttttcctgatgactgcctgtggagatgatgactattattatccttcggtgaaactggaatttgtgactgtagaggccggagaagacggtcgcatacaaacgcttattcctgataagggagaagtcttgactgtttcggaagaccgtacgggttctactatctctccaaacacttccagacgtgtaatgagtaactatgaggtgctttccggtgagaacactgctactatatattctttgcaatcgctcataacgccggtacctaaaccggaagatgatccgatttacaaggacggtataaagctagatccggtagagatggtcagtatctggcttggaagggattatctgaatatgattttgaatctcaaggtcagtacgggcaagggacatgttttcggtatagtggaagatgtgtccgaacttaaaacaaatggcattgtgaatatgttgttataccatgatgcgaacagtgatggagaatactataatcggcgtgcttacatttctgttcctttggcgcaatatatagatgaagagaatccgggtcggacgataaaggtaaagtttaaatattatacgtacgataaggatggttctccgatagaatctgataagtactgtgatcctgggtttgactatactccgggacagaattgaataatggagtgtatatgtttaaattgaatcaattaatcgtgggaatatttttatttctctcttcccttttctcttgtcagcagaaaggggattttcaatcaatgaatgtagaggagtttgattctcttattcagaatgaggatatacaacgtctggatgttcgtacacttgcggaatattcggaggggcatatcacgaagacgatcaacatcaatgtgatggatgactcttttgcttcaatggctgattctttgttgcaaaaagacaaaccggtggctgtatattgtcgcagtggaaaacgaagcaagaaggctgcggcaattttgagcgagaagggatataaagtttttgagcttgataagggatttaattcctggcaggaagcaggtaaagaaatagagaaataaagtgctgatttatcagcactttatttttgggggttatttcagtccttccaataaccttttcagaacgacagttgccgagatttcacggttggcagcttccggaatcacaatagattgcggactttcaatgacatcgtctgtcacaatcatatttctacgaaccggaagacaatgcatgaaataagcattgttggtaactgccatttggcggtcgctgacagtccaatcacgatctttgcttaatatctgtccatagttgtcgccagaataagcagcccagttcttggcatatatgaagtcggctccttcgaaggccttcatctggtcatattctacttttgcattacctacaaattgcggatcaagctcataaccttcgggatgagtgatgacaaattcgtaatccgttgcattcatccattcagcaaaggaattagggacagcctgtggcaatggacgtggatgaggagcccaggtcataactactttgggacgtactgttttcttgtattcctcgatggtaatcaggtcggcaaagctctgcaatgggtggcgtgttgccgcttccatcgaaaagacaggacgtccggagtattggatgaattgattgataatagtttcctgatagtcaaagtcacggtcttcaaaacgggcaaaagagcgtactccaatgatatcacaatagcatcccataaccggaatggcttctaatatatgttccggtttatcaccatccataattacgccacgttcagtttccaatttccatgcaccttgattgatatccagtaccattacattcattcccaaattgatggcagctttctgtgtgctgaggcgggtacgtaaactagagttgaagaagatcatcattaaagtcttgtttcgtcctagttctgcatatttgaagcgctcttttttaatttcgaatgcttctgcaagggctgattttaaatcgccaatgtcctgtacacaagtaaatttcttcatatcatttattttttaatttttaattagcttcgctcaaaaccttgtttgatttttaacatataggtatagtctcaatttcttctcgtttgtccatctccttcaatgacccatttgtaagaagtgatttcctcaagtcccatcggaccgcgtgcgtgtagcttttgcgtgctgattccgatttcggctcctaatccgaattgtgccccgtcagtgaaagcggtagacacattggtgtatacgcaagctgcgtccacgattctggtgaataaagctgcacgttccccgttctcggtaacaatacactcgctatgtttagaactgttttcctgaatatgtcctaaggcatcttcgaagctctttacagtcttgacagccattttataatccagaaactccgtgccgaagctttctgcttttgcatgttccaggagctcggcaggatagcggccttccaatgcctggtaagcttgcggatcagcataaataatgacatggctgtcttttagtttctcgcaaatcagagggaggtcggccagtctcttctcatgtataatggtgcagtccaatgcattacatacgctaactctacgtgtctttgcattatgaataatgtctgctcccttgtttgtatccccaaattcatcgaagtaagtgtgacagatacctgctcctgtttcaatgacaggaatccttgcattctcgcgtacgaaatgaataagactgctgctgcctctggggataatcaagtctacgtagcccacagcattcagtaacgctgccgtagcctctctatcagccggaagtaattctacaatgtgcggattgattttgaacttcttcaatactttgtgaatcacactgatgatggcccggttggaacaatcggcgtcacttcctcctttcaatatgcaggcatttccgctcttcagacaaagggagaaaacatcaaagctaacattagggcgcgcttcataaatgattcctatgactccgaaaggaacgctgactttcgtcaacttcattccattgggacgaacactctctttcagcactttacccaaaggagaggggagtgttgctacattgcgtgtatctgcggcaatacctttcaaacgttcttccgttagtttcaaccgatcgtacttcggatcatttttgtccatccgtgcgaggtctttttcgttctctgaaagaatgaaaggtgtttctgcaattgctgcgtcagctactgcatttaaaatctgattgatgacattatcattcagcagggctaattcccgacttgctacttgtacagcggcaaaggtctcgtttaaatttgtagtcatttgctccttttttgcattaaatggaaagataaactatgcaaatatagtgaatgatgtgaataaaacttgttgaaaatagaaataaatgttgctctttacttattcactggtttttttacaagattaatactaaaaaaatacgagactcaattctgaatctcgtatttttcatttatgcactatattggtatagtgcttgttattcgaactcctatttggcattatctcattgccatggaatgtcttgttcaatatcttctcccatttctcctgattcgacttcaattcctatgtcactaggtgttcctatatgttcgatattggttagtgcgatagaatgggtatagtttctcttgaatgtgatactgctactgatgattgtcttttcttctgctcctggagtctcttcccaaaatacttccacttttacattctctgttaaatgttgattatcaccagtaggtatattggcagtgagatttctcatgctgaccatttttaattcagattcaacagtcttatgaatatctgcattagcattcaaatagatgcttggtgcgtcttcaagttttattctaagacgtcctttctctaaacctgtttgtttgaattttactccgaaaaaacggcgatagagcatgatgtgattttgcatgccatctgtcacttccactttatcgtttaatccatgataacgttcgatgaacgggcggttgcaggcgtcttgtgatccgtttctcgtttgtattctcgggttttcaatattgtataagaatttgattccatctgcttgttcggcagtcaggaatttgttcaggcattcccctttgatttttccgctacgttccaaatcgaaaggggctccgaagaagcctttttcgtcttttatgattgagtcctttgcatttgcaatcatagagcaagagatgcggtaagtgtatccatcaataacttttatttttaggttattgggatctttcgccttgtctaactggaaaataccataagcgtatggttttgaagatggattctgtccctctttgggtgtcatggtaatggcgattcccactaatgtttcactttcattaattttggttggagttgtagcgcgtgccatgggcagttcggttgagaggtagtctccgtccagttgtaagttaagttcggaatacgtagtaggaggtgcctgatacagatctttctccttaatacatgattgtagagtaaaagctgtgaatagacagcctgcgatcataagatgtttgattttcatatgaatcttttttagtagttgttgagtatgattattatttccctatttcttgttctgattcttccatttctgcttcttcaccaaaagagatagtagcatcccctatatgctcatctatcttgactattttgactatgttctttttgtttcttttcattttaatactttgattggtatatagagaataccatttctcttcattggccgggcggtaggaaatagtgaaagcgattgtttcttcttccttaagtttggccgtataatagtcggatatatcgtacatagagataattcgttcctccgtccgggatgttccatctttggaatatagtagataaaatggagcaacgtccgctgctttaattttgatggagtcacccggtgcaagttcgtctgtaacgaattgtatagaataataagcacgtttcaatgtcattgaaacggaggtattcatattgggatttgaaaagtccaattgctcactgccgaaaaagcgtttgacggtagggtgagtactagtactatcgcattttatatgcatttctcctttgtaaatatgttggtgaaatgccccattgatattcaggggattgattgaaatctttaaatcgttgttgactaacccgttcacctctttctgcagagtagatgaaaaaggaagtccataaagtatgctgtcactttgtattgtataatatgggcggtctttatatcccaggaagctgcagtcaaagcgatacacatatccttcgattaacccgatttctactcgatatggattatcgaaaaggcctgaagcatagggctggaaagaagtcaggccttttcctttccaaaaaacattaactgcatatattccgtcagccaccgtggaggtggaacggcttaaaggttgttcggctacttcaagaaaaggagctatatttaaactgacattaaactctctgccgacaggaaatgacggtgtactgtttacttcaggttcattcttactgctctcacaagatataattgagaatgttaaaaatatgagtataaggttccaatgttttagtagcatggggattatattgtttgtttagagggcaaatatactgctattaatagttttttgcaaataaagtccctgtatttatgttgcagatgtctatctataatacattatataactgaaaataaaagcgcttatcttcactaaagaagctaatattctacctgaataagagcttcatttgggtgcagaaatgaggtaaactcatacaattataattcaaaaaaacttccgtaaacattctcaactatacttatccctatgagaaaaaatactcatagggatgagaagaaatactcattacaatgagaactttttctcattgcagtgagaatatccccttgctagaataggatgaaacagtttattaccgtgcagtcatgaacaagattcacctctgtgtactctgtggtgaaaaccgtacagaaacaagctaattttagtctaaaatcggataaaacagaaattcttattattaattattcaatgtatagatagtcataatgtactactggtttctttccatgcttgccaatcgcttcttgtgcctgtttggagtcacagttcacttttccaacgccaacctggtttccttgaaagtccatgatacgtacaatgtcatctttctcaaattcaccttcaatatgagtgattccaatcgggaggatgctgacagctttttcagagtttagaacttctgtagcgcatttatttatgtgaatttcccctttggcaaaaccttcgctatgggcaatccactttttgacgctggataccggttcgtctgatggtataaaacgtgtacaaagagtttcttcaggatgctgtaataaatctaccagaatattatcccgcttcccgttggcaataatcactgtaattccttcatcagcaactttgcgggcaatattggttttcgtcaacatccccccccgtccgaaactggacttagttgtctgaatatagttggataagtctttgccgtgaccgatctcccggataacagaagagtttggatcggaaggagaaccattgtaaatcccatcaatattacttaggataatgagtgcctgcgtatccatcatcgaagcgatgagtccggacaattcatcattatcggtgaacatcagctcactgacggaaatcgtatcgttttcgttgacaataggaatgacattgttttcaagcattaccgtcatgcaatttttctgattcagataatggcggcgagttccaaaactttccttcgttgtcagtacctggccgacaggtatattgtgctcacggaaaagttcgtagtaacggttgattagtttggcctgacccacagcagaaaataattggcgctgatctacactatcgagttttttctgcggatgcacttcactgcgtccggaagcaacagctcccgaagaaatcaaaatgatttctaccccggacttatgtaattccgctatctggtcaacaagtgccgacatacgggtaacgtccagcgttccgtcgcggcgtgtcaatacattgcttcctacttttactgcgattcgtgtaaattcctgtttcatccttactaacgatttgaaagcacaaatatagagctttttgccgatatgctacctaaacaggctaaaaagaattatctttgcagctagatagagaaaagataaacaatgaaacatacaaatccacaagtagaacagatgacctccttcatcgtaatggatgtgttggagagggcaaacgaattacagaaacaaggtgttgatattattcatttggaggttggtgaacccgattttgatgtaccgtcttgtgtgtcggaagcagcaaaagcggcttatgatcgtcatcttactcactatacacattctttgggggacccggaactccggcgggaaattgctgctttttatctacgggaatatggagtgacggtagatccggattgcattgtggtgacttccggctcttctccatccattcttcttgcgttgatgttgctttgcaacacggatagcgaagtgattctttccaatccgggatatgcttgttaccgtaattttgtattggctacccaggctaaacccgttttggttcctttgtctaaggagtatttgcaatacgacatagaagctattcgtaaatgtgtgaatccacatacagcggctatctttatcaattctccgatgaatccgaccggaatgttgctggatgaaaaattcttgagggaagtggcggcactgggagttcctgttatttcggatgagatttatcatggacttgtctatgaaggacgtgcgcacagcattcttgaatataccgatcaggcttttgtcttgaacggattttctaaacgttttgcgatgacaggtcttcggctgggttatttgattgcacctaaatcttgtatgcgttctttgcagaagttgcagcaaaatctatttatttgtgcgtccagcgttgcccaacaggctgggattgctgcattgtggcaggctgattcggatgtggaacggatgaaacagatttatgatgagcgtcgccggtacatgattactcgtcttcgggaaatggggtttgagattaaagtagaacctcaaggagcattttacatttttgccaacgcacgcaaatttactaccgactcttatcgctttgcattcgatgtactcgaacatgcgcatgtcggcattactcccggggtggactttggtacgggaggtgaaggatatgtacgcttctcctatgcaaactcattggagaatatcaaagaaggactggaccgtatcaatcgctacctttctcgtctcggcttctgattagctcggtggctgcttcgtattcttcctctgtcacgaggacggatacggaaggagcgatatagggtgctaatgtccccataattccatctttgattacacaacggatattattgctttctaataaccctttaatgatctcggcttcccagggggatccggagaatacttctattgccttgctataatcttcttctttcatgatcttacttattaggggttgttatctacaaatataacaagaactcgcaaaaaaacggcaaaatttggataaataaagtaagtgtttggtattgaggagagttaagccaaattcttctatacctttccaaatcgctaaaatgcaggataatgaaaggttaagagaaagatttgctacttatccgttgccttttttagccccggataatccggcaaaataacgcttaaccacctgcggttttaccgttcaccatgcaaagaaccctatattttgcccgtaaagataaccgtttttttccgtttttcatggaaatacaggttatgttaccggcatccggggttttattctttgttccgctataattttcataactgtaaataactctatatcaagtaattttgcaacataaaaaatagagttatgaaacagacggatgtaacggttacgttctacctcaaaaagagcgaaatgaatgacgagggacattgcccggtcatggcgaaacttgttgtcggcaaattttcagaagcggcttttagtgcgaaaatgtccgtacccgctgcactgtgggcatccggacgtgccacgggtaaaagtaacgccgcgcgggaaatcaaccggcaactggacgatttgcgagcttcagccatttccatttatgacgaactgtcagccacccgtgagaatgtaacggctgaagaaataaggaatctgttgttggggacggctttcgggcaggaaaccctgttgggttatttccggacgttcatcgaacatttcgaaaaacgtgtcggcgtgaaccgggaaaagggaacagcgcaatcttaccgctatgcttgtaactgtgtggccgctttcatccaggagaaatacaagttgtcggatgttcctttcacggccctgaaccgttcattcatcgacaactatgacctctacctacgcacggagcgccgctttgccctgggaactatcgtgttgcttgtcacacggttgaacacgattgtcggggaagccatcgcggaagggattatcactgccgacccgttcgcgggttatgaagccgaacatcccgagcgggaacagaaataccttaccgcagcggagttacaacggctgatgaccacacccctgcacgacccgaaactctaccatatccgcgacctgttcctcttctcctgctacacgggtatcccttacggggacatgtgccgcctgacgacggaggatctggaagtggccgaggacggtgaggtatggatcaagaccgcccgcaagaagacgaaaatcgactatgaagtgccattgctcgacataccgttgctcatcctcgacaagtaccgggatatggccccggaaggaaaactgctgccgatgtacagcaacaacgaactcaaccggacactgaaacgtattgccgccatttgcggaattgaacggaagctcgtctttcactgcggacgccatacctacgccaccgagatcacgctttcgcatggtgtcccgcttgaaaccgtcagtaaaatgctggggcatagccgcatttccacgacgcagatttacgccaaagtgaccgatgacaagatcgacatggatacccggtctttagaggaaaagattgccggccgcttctccgtagctatttaatctatcattgacaatcaaattcacaacgattatggaaacgaataataaagagataaaacgtcgcagcacgttctccctgctgttctacatcaaccgcacgaaagtccgcaaggacggaacatgtaaattgttatgcaaggtaagcatcgacgccaagtcggccccgatcaatatcaacgcgtttgtcgatccatcgctttggaatccggaaaccaaaagggcgaacggacgaagcgagaacgcccgaacggtaaacctggcaatagagaaactgaccgaaaaaatcaccgggcattaccgtcatattcgtaaaagcctcggtttcgtgacggccgagctggtcaaaaacgccgtggaaggaatcgggcagaaaccgttcaccctccttgccttgttccgcgagcataacgaggagttccgcaagcgtgtcggcgtggatcgcaaggaagaaacctatgaaagttacgagaactcctataatattttagcctccttcgtgaaaaaaaggaaggaaaaggaggatgtagcgttgcggagccttgaccgggagttctacgatgattttgaaatattcctacgtacagatcgtgaaatgaaacccaagacagtacacgagcatctttaccggttgaagaaaatgaccaagcgggctgtcagtcagggtacactccggcgcgacccttacgggaagctgcacccggaactgccccggcgcaagagccgccatttgaaactcgaagacctcaaaaagctgatggaaactcccgtcgataaacccaacctccagcgggtgcgggactggtttctcttcgctaccttcacggggttgtcctacgccgacctgaaacgcttgtccgaaaaagacatcacgcagtcggacgacggaacgtactggatacacatccggcgccagaagaccgaaacgccctcggccatccgcctgctgaacgtgccgttgcagatcatcgagaaataccgccacgagcgtaaaagcgacaggattttcaacctctattgccgggggtatctcatcaagctcaccagagaactgggacggacatacggcttcgacatgacctttcacaccgcaagacacaataaaaattgtatctttcaagctatgagataattaacagagaaacaaaacagacttgttaacggtttagaaaccagcgaacttctataatctgcctcattttgcatcaagcgaaagaacgtccttactttttgcaaaggtacaaaacagtccccgtctttgcaaaatttcccgcaattttatttcgcccgcaaattttatcctccatcatttttcctgttctgaaaacggcttccggcttgatgtgcgcaagcccatttcagaagcagcacaagcaaagaaaagcccacgacgaccacaatgtcaccagtgacactgccatcgtcgcggacacttcttttatgtgcttgtgctgaacggccaagaccgtcttattcgtttttcttttttcgtttccgttgtcagccggaaatgccgccggatgcaggacacggcaagcgtgaatctgctcctgcgactattcccggctgtcatgtgtggcctgtcttccaaccgtcttgccctgccgttgccaatcggagcaatggcaggcaagaccattttcagacagatgccgccggaggaacacccgcgaccgcaagccatgcccgcatgacaatgacggtcacgggacttccgtcacggcggcaggaaagcgaggctttcccttgtcagttgcgccgccctttcgattttcctgtggcgcgttgcgccatttcacatacttcccccttttcctttccgtctctccaagtgtatgccaatgtccccatgccgccattccagacggcatcagtggtcattttcgttgcaggggcaaaggtaaagacgggattaggaacacaaattttttagccacaatctccacacttcgcaggctcaggtagtattctgtcgaaaaaatttgctgaacctactcccctgacctttgctttttcccctgaaacgaaaacgaccggtgcgcggtcggaagacgtcacaaggagacatcggacatacggagaggcgaaaagaaaaaggactcgacccgacctccccatccgagcaagacaagtaacaacaatctaaaaattggaagatatgagaatgacattgaacgacatcggaaaggctatgcggagcgtattgtccgcaatggtgagagcagcatggggcattaccctttgcgcaggaggtttggcggtgggcatcgcaggggaaatcctgctgggtatgttgaacttcatgttcggcatcctcaccgccctgctttcagtagtggcagctatcggaattttcatttggttattaaccctttaattcatacggatatggcgaaaagacacagcaagacagtggcacaacaatgcaggtattacgaggtggacaacatcttcgagtatatggtagaggtgtgcatcaacggtaacttttcctcattcaggaggttgtaccacgagttgaacaaggaggcaagaaaggacttcatcgcctttctcatcttggaatgcccgccccaataccacatagagattttacagaaaaccgtataaccatcttaaattacagacaatggaaacttttgacttttatatggattgcaaggtaacttgctgggaacgtacccgcttctccatcaaagcgaacagctatgaagaagccaaatccatcattctttcatgggaagataaagacgtgaacagccatatcggtatggacgagaacgtcatctattgcgactacgaattgaaccccgaaacggtggaaggactgtcccctgcggaaaacgacaacaaccctacgatggaaatctacggacgggatgacgagttgttttatcacaatatgttggacgaacaatagagcaaagttatgagaacggaaacgaggaaatacgaagtttacaaggtggacgagctttcggacaaggcgaaagagaacgcctattggaagtggttgaaaggctttgaatatgacgcatccgacaacagggcaacgttgaaagcctttgaggagattttcaaggtaaaggtaagcaggtggaattatgatgcctgtacctataatttccaattcatctcaaattacagcggggaagaggaagaactgtgcggtgtgcggttgctgaaattcatcgtgaacaactattggcacaaccttttcaagcccaagacctattggcacaaaaaggacttccacaaacagcgcagaagtcggatatccgtaaccaatgattgtgtgctgacgggttattgtgcggacatggacatactgaaacccatatacgactttctgaaagtccccgacaagcatacgaacttgtatgacttgatgaatgactgcatcgacagctttttccgcttttgcagggatgatgtggaatatgctagcaacgaggaagcctttgagcgtgattgcgaagccaacgaatacgagtttttatccaacggagaatttttcaaataactaaaatacatacagatatgaacggaacagaccatttcaagcggaccatccaagcctatttggacagccgtgcggcggaggacaagctgtttgcagcaagttacagcaagccgaacaagaacatggacgattgcatcacctatttgttgcattgggcgaaaagccaatgcaatggaggcaacggcataggcgttaccgcaggggaagtcttgtcgcaagcggtacactattttgacgaggacgacatcgacatcggcaaaccaatcccgtgccaagtcatggtatgcggagttgaactgacggacgaggaaaaggcggaagcaaggcagagagccatccgccaataccaagacgaggaactgcgcaagatgcaaaaccggaacaaggctaaggcgaaccaaaagacaaacgcacaacaagttgaactttcattattctgaacctatgaaacccaagacacccatacagaaagaagtcatccgtctgagcgcaaccctgcccgaactgacaaacgcacagagaacctacgctttccaccattgtttcaagcactacggcaggcggactgcaaaaggcgtcattacctgcacggagtgcggacacgcatggaaaagcggacacagccttgccgacacgctttgcggatgcacctgcccgaactgcggcacggcattggaaatcacggacacccgaaagagggtgttcgtggacaacgagtatttctccatcatcaccacctgcaaaggctaccaggtaatacgtttctttttcgtcaggagccgtcagaaagtcgggcaaaaggcggagtattccatctttgaggtggcacagcggtggattgctcctgacggcaagtccgagacagtggcaaggttgcgtggcttttcacttctctactacgacttgtggaacgaggacagcccgatggaaatccgcaggaacaaccagcataaggtgtatgacattgacccgatatgcacctatccacgccgacggattatccccgaaattaagcgaaatggctttgacggcaacctgcacggcatactgccttacgacttcttcaaggctatcctttcggacagccgtgcggaaacattgctgaagtcgggcaacatcgaacacttgcgctatttcctctcccgtccgcaggtacttgacagatgttggaactcgtacaagatagccatgcggaataaatatgccataaccgacatctcattgtggtgcgacctcgtatatctcttagagagattgggaaaagatttgcgcaacccccgtttcatatgcccgcccgatttcaaggcggctcacgacctgtatatggggaaacggcaagtccaattggagcgtgaacggcagcagcaacacagggagtgggaagccgagcggttggagcgtgagcggaagcgtctggaagaaatggcgaaagagaaagacgagtatatccgaaagaaagccgcattcctcaaccttgtactgacggacggtctaatcatcgtcaaggtgctgcaaagcgtggacgagttctacgaggaggggaaagccatgcaccattgcgtctatgccaacgcctactacaacaatgagaactccctgatactttccgcacggatagacgagcgacgcatcgagacagtggaggtggacttgcggacattaaaagtggtgcagagccgtggcgtatgcaactccaacaccgaataccacgaccgcatcatcaaattggtggaggacaatgccgagcagatacggaaacggatgaaagaagcagcgtaatcgtttaacaacttaatacttattgatatggaagtgagaatagaaaacatgattttcgggtggcacgagaaactgcctgaaatgttcatcgaattgttgaacacgcttgtactgacaaaggacgagcaggatgtaaggggggtaatggaggtgttcgcccgaaagaaacttttcaacgcccttttcgcattcgggtatggcgcacaccatctgtgggtgacacagaaaaaggcatccgaccccgaccaatgtttggagaacagattactgattgttgaattttaattgataaggctatgacaacaagaatgactattaacggagtaagcacctgcacggcaggtgagaaatacgagaaattccaactgaaaatcgggcgcaaagtccgcacgatgtaccaatatgactatcgggacaccacaacgggagaactgttctcctgcgtgaaacccacattggacgagtgcaggcggttgcgtgacgaatggattaaagcgaaggagggcagacgatgagcgcaggatatgaaacgctgatagtgacgttcagcgaccctatcaaggttttggacaatatgttcgccgatgcggacgcatggggaacggacagcctcaaaggatgggtggaggactatgaaagtacgaggtttacgcagataaacgggcatacggcagtcatcacttccgaatacaacatgccctgcgtaaaggaatggctcacacgctgcacggctatcgccgacataaaggaattttgagtgcgtggcggtggaaacaccgcccacactccattcgtaacaactgaaaaaacaagcgaaatgaaatactatttcatactgacagacggcagggacgcatgggtgcagttcgtttacctgcccacgcaagatgaagcgtccggttatatccgagatttgcggagcgtgggaatatccgtacacgggtataacctttggaacaaggacacacgccccattgccgagcgcacacttgagcgtgtgctgcaaaggataaagcggtaaaatcgggcggcaggcttgccgcccgctactttctttcatgagcaggtcggcggataagaaagtagcaaagaaaccgttgcccccatcttcgataagatggaaaaatccaatgaagtcattaattatatatcccagtctggtttgataattgtaggataacgttgttgcctgacaatctttaatttttctatataatataaatatatctctttgtatgaaccaaaccccggttgctgcatatcctctttgatggataagccatcaaaaacaagaagccataatcttaaagcaacccctaaatagccccaaagaagatccatttcgtgcaattccagtttagtaaccaaattttctattcgaacatccatatctggatgggttccaccaccagaaatagaatcctctcccattaataaaagggctgctaatgtagttgcaattcctgccttataggttcttccccatgcagagttatattcagtttgaataaagctaattgccatatcatctgctgcaatttcatcatttattgaacgagaaagcgtttgctgtatttgtgtatgccccaaataattatgtgaaaactcgtgagcatatataaatgctattgcagcacaatagacatcattcgcatggcttataatattttcaaattgctgcggattacagatatttggagtaacccaatatgcatctctattaaagttatgtaataattgccgtcctctgaaaaaacaatcattgccatattctacatctatcatattgggcttatatccatttttattaataccaacagcatccatcatagggatatgtataacattttcaaaatatgcgataagatagacacaaacagaccataaatactgacagaaattttcgttgatatatatatgatttaatttattattatcttttttaatttccgcaacatcactaatagctttctcatctcttatgaaagtaaatcggcgagaaaaattattgctattgcaatcattttttacagcatctaataactcaaaaactttttcaatatattgaataacatcatcagataactgttctacaggtaaataatagatttctttcggctctttcatttttcgaaaatttatttgtaaagataatatgtttatttgtattggaagcaaaaattccttgcgaaattatttaccgcaaggaattttaatcatatcacggaatatatagcaacgcaaattctgtttttcttcgattgaatagcatggcgtgctgctttcctttgtaccggcagtaagcgatatattcacggtaaatgtctcgattcccggcttccagcttgcggatgagtttgcttttcgggtgtccgccgtgaccaagcaataccccttgacccacattgaaacttaatacggtaagaagcaaggcatctttaccaaatttgcggaacagcttgtagcgcaccgccaaatccttgcggagcagggcttcggcttccgcctccgtcatgtcataggaaaggttttcgttgggcaacctgcgatgcccgtagccgtagtaggggtaatcggaacggtcgtgcagtccctcgtacttttttatcagttcaacggcgatgtcagccttgggatgattgttaaacgatgccagcagttccgccatgctgtccgtgtcttgtgccggcaggctgccacagagggcagccgccagcagcaggagcaacgccttgcgcatcatcggctggcgttcaaggtgtcagacacagcgacgcctccctccgtttccgcgtccgagtcgttgttgaactccaattcccactcgcaggcattgccgaaattgtcctccaccgtgatggtcaggctttgcgactcgtcgcactccgaggtgtaatataggcggaatttttcgttctccagcaggtagcggtcgttgggctgcaacaccaagccgttatccagcttcaacgtgccctccccgtcgtattggaaatagcggatggtatagaccgccccgtcaaactcgccctcgcgtaccagttcgcaacggatttccgccgtctcgccctgcgccagttccttcggcacgggcatggcttccaccgtgaacggataggcttgcgtcacgtccaaatcgtcatcgcaggcggtgaagcatacagagagcagccccagacaaagggttgccaatgattttactatgtttcttttcactttccgtgtattgtttaatttgttcatgttcataaccgttacattttaagtttgatgttcttgttgttcttctcgttttgtttcagacggctttgcagatactcgttcaagtccttgcatccgccgtagatgccggagcagtccgacaccctttcgccgtaacgtgtgcgcagggcttccaatgtccgccgcccggcttcgtcgttgtcaaggtggcaccgcaccgttccgtagccgtccagatgccggtacgccctcgccacattggacaccgagttgaggacaaggtggtcctccccgccgccgatgcctaatgcacgggcggaaaggtagtccacaaagccctcgtacacgttgcaaacggcagagcctgacggcagcagggtgacgtcctttggcggcacacagcccttgaagaacgggttgcgtatctcgtagccgccaccgcagttgccgaaagccacggcgaaataccgtttcccgtgcgtggagtagcgcatctccttgcagttcgcgatggctatggcggacggtatgcccctttcttgcaggtaatggagtaacgcccggctctgcaagggcagcacttccacgtcctcgaagctgtgtccggctggttgccgcacttcgggggtgcggcgttgctcatagtcctgcaacggcatgtccgccacctccgccacatacctcgcctgtgtgaggaagtcgccgctttggatgaactcccccgcaagggcgaagatgttaccgcccttgccctcgccaaaatcaaaccagaggttcttttccgggtttaccttgaaggaaggcgtgtgttcctcccggtacggcgacctgtaccagatggcgttggcacgtctttgcacgggatgatgccccagccgtgcaaggaagtcctccagcggatagcgtttcatcgcttctatatccatataggcgcacattcagttgatgatgaacttcacgcctatcccgtattccgtgtggcacacgcccatgctgccgccccacaggaagcgttcacgcagcgaggccgtcagcgcaatgaagtccacgaggtacagctccatttccagcgtggcggcgcagccatagacaaaggcgtccttgttgttcagcctcgccccgtcgtacagcgtctttccgccccagttcaccgtctcgtacccggcaagggctgacgcgccagcgtagaagaacaccacctttttcgcgtccgagaggaagttgtagtagtaaccgccctccgccgtgaactgtgccgcagggatggtcgtactccggtatccgtggctggttttcaggtattccagcccgtacacccacttgttcccacctttcgcgtagctcgaaagcatggctcccagcacatagccgtccgcctcgttcagcccggctctcaactcgatgccccgcatcttcggcaggcaccgttgggcttccgcccgtcctgccaggaggacgaacagaagcgttacaataaacagtacctttcctttcatcgcacgcgcagttcgttgatggtttcagcctgtaccaagtcctcgttctccacggtaaacgtctggtggcgtccgccgtccttctcgttcatctccaccacgagctgcttgccgtcggggatggtgaacttcggaaggcagaacaccgtgcgttcggaccgcttcccggctacacggacggcgtagttgtaggcgcggagcgggaacagcacctgttcctgcatggcggtacgcttcgccaccttcttgtccacaatcttgaacgtgatgtagtccacgtcaaacggcacattgctttggttctttatctccgtgtagaaatacagcaggtcattgtggacataaatccctttcagcaggtactggatgccgaaacgcttgcagccgatgtgcttcaccttgcgcttgtcctccttgtgcagcgacttcatgatgaggtgtaccagcatcgggctttcgctgcccagttccttcaggtagatttcctgcgcgttgttcggtcggttcaccgtgctgccgtcgtggataaagtccttcatttccacgttcaggataagcggctcatcggcgtatttcacattaaatgtgtaaaatgacccgtcctccgtgatgacgctcatgttcgtctcgttgcggaaattcttgaccgtcgccttcacacggatgacgttctccgcaccgtccgccttgcccgctatcaggttgggcgaacccaagtccacgtagcgcaccgccgccggaaacaggatgtggacggtcttgtcatacgtgacttccaagccgtgcggcggtatcatgcggtcgaacatcagctttttcgtcagaccgtggtacaggtcgccgtcctcctccgtctgcggatagacgtccttcaccagttccagcccgtcctccttggcggtggcagtgctgtcgttcgtcactccctgcgcgtagctcgcacaggcgatgcccatcagcagggcaaacattgtcattactttcttgatactcattttacgttggatttagtggtaaataaaaattagtttgttgattattttttctttttttgcctttatgtttttggactgttcattccttttcttggtagagcaataccctgtaccctgacttcagatgtaccttgaccgtgcgcatccttttcgagatgtactgcgagatgccctgtatcgcccctcgccccaagtcggaggcgagctgcgcccccgcgtcggtcgatatgttgatgctgcttccgagcgagctgcccatgttcgccccgatttcctttgccgcgtctatctccatcgagccgggtatgaagatgcccgcctgcccgtcgctgtcgtacacctccagttctaccgggatgatgtttcccccgtgttccagcgaggtgatgccgatgccgagcctttcgccctgcaaccgtgccgcgcccacaaggagcgtgttccgggggatgacgcgccccgacacgcgcatcggctccagcagccggagcttcaccgtctgcccgtccgtcagcgtctggtcgccctgcacacaggcggcgatggtgttcttccccgtcgtttcctccgcaccgatggcggtgtggaagccgtagttgcgttcccccgaatagtccgcgatgaacgccgagtctgtcatgggctgcggcagggcggacaccaccgtccgccttacatcgcttacgggttctgccttcatgctcttttcgcctgtactcacagaacctcccgtttcatcgggctgtgcggcttgtccggcattgttgtcattctggtacttcgccgccagctcataggacttttccaacagggcgacctgttcctccatcgtggaaggcttgctatcctgcgccaccagcatggcttccagttcgtcgatgcgctcccggagttcctccttttccgtgtcctccttcggcggctcgtagaacgtgcccagcgaggtgttcagccgttggtaggcggcagcggaagtgcggatgcccgcctgtctttcgtccgccgtttccccgtcggtcgtttccgtccgtgtcaggcggtaatcgtccgaagtgtcggcatcgtccgttggcgtgtcaccgtcgctgtcgttccagaacgcggagaggtcgcccaccatgccccggcgttccttccgcttgttttccaaatcctgctgctcgtaggctttcgccttgtccccgatgattttggagtcttcgggcatgggcatgtccgtgttgaatccctgtccctgccgttctttctccttgtcctcggaggacggcgcgaagatgagccacatacacccggcgaacagcagcaccatcagcggatagaccagcatcttctgcctttgctgacgctgttgttccgtcagcggctttttctcttttgttcttgattcattcttctgttcttttgtttccatcatcagttcaattagcttgtcaaagtctgatttttatacctttattctctttgcttacctgattctgtaagcgaatgggcattttatgcgtacccaaagaagccggatggagctttggtttgtttttatccggaaacaacctgtgttccaagcgttccaatcctatccgggactgttctttgatgatgcggttatgatgccctaccatatgcttgggataagtatcgtctcccatgtcacaacggataatgtaatccatcaacgcatcgcttatttttccgaatgattccgccaacccatacttgaccaacagaggtttcggaatttttgtctgcccgtcccatcccttttgagagagtccatgaagcaccatccgttcccggtgcagggctttccgatagtcgtccgggaacttgccctgcactttctgctcgtacaaatcggaggcactgcgcataatccgtcctttttcctcctggatggccgcatcgatggagtccgccgaccagtgattgtccgcacgcatttccttggcccgttcccattcgaggtcctctatcttttggtacatatccatcagaccatgcctgatggcggtcaggtctcccggatattccccatgcagggcaagccgcttcaagtagtcgagttcctcgtccttcatgcaataccctaccagcttatgggcggtagccacttcttccggattgggcagaggacatagggtatggcttttacccgtatgggcactacaaagcagcgtgtacatggcattcagtttttggggaagtgtttcattccccattttcaatccggacaacaaccagacctgctgtttgccccaatcggtttgttgcagtacatccataaccttgtgccagccgctgcgttccgtctggtccagattccggaagaaacggtaatcccagagtatttttgcctgctcttccgtaattgccgggcgatgcccgttccttacgatggaatcggcaatggcattgtaatccaagcgaagcacctgatggcagaacttcaaggtcggtttccatcggaatccggcatcctgcaagttttccatcttttcccatatccaatctgataatttcattgtggattcaaatttgagtgatacaccttattatatatttctaacttctcgatgtgccgtatctccaatgcctcttcccctttgccgaagccgatgattgcggcggcagtcatgtagagacagagcgaggcgaacacggcaaatgccgcaaggactatcctaagccgtgctttgggcggcagggcgtccagcctattgcgtaaccaacctttcagcccggtggtccacttttcaatgagatttttcatctttcccatacgcattatctttcaatcgtccggatgtccttgttctccaataccgtgaagccctcgatggtgaagccgtttgggttgtcgtccgagcggctcgcgttgagcaggcggcaggcggttactaatgtccgttccgtcacgttgctctcgcggataatcatctgacgggcgtatgtccgcgcctcgtagggatagcggtcgaaattgcacaccacgctgtccacctgcaacacttggttgatgttcccggcgatgatgcggttgtagaagcccttttcggcgaagtcggcgtaatagttgtacgcgctcttgtctgccaagagcagggcgcgtttcacgttgtgctctatcgcgcttttctccggcgagagggtgaaaaacagttcgtggaagcggcgcacgtgttccctggcttccgccgggcggttctgcgacaggtcctgcgagagcgcgagcataagactcttgcctccatcgaggacgtatatcttctgccgttgcgcctcggcgaagcggaaggcgcacaccaccgagcagaccaccacgagggcgcaggccgccgtatagacgatgccgaacagacgtatctgccggaaactcgtctcgatgttcttgagtgatttgaattccattttcttcttttcgtcttttaattgttcaataatccgtttttaagggtcgggcaactcacggaaacggattgtccggaatgcctatcttcggaacagctttcccgccgttcccttgatgagcttgcccgcgcggcctgccacgtttcctgcggcggctcccgccacgctgccgcccaaagccccggcggtgttgatgttcttgttgtagctgcctatgccgccacctgcttggatgatccagcctgccaccgtcgggatggtgaagtagcccacgatgccgatgatgaggaacacgatgtacaccccgttgctcgcctccaccgagaagttcgggtcggtctgcatcgcttgtatgtcgttctgcaacatcagaatctgtatcttcgccagtatggtgctgaacaaatccgacacgggaagccacaggtaaatctgtatgtagcggctgaaccacgccgagagcgtcgagtggaagccgtcccatacggcaaaggcgaaggctaccggtcccaggatgctcagcaccacgaggaagaacgtcctgagcgtgtcgatgatgagcgcggctgcggcgaacatcagttccagcagttcccggaaccagtcacgcaccgtcttcttgatgttgtacgccgcccggtccatgtacatccccgtcatcgtcaccaagtccgagggcgaccagcccagctcgtccaactggcggtcaaattcctcatcactggcgaggtaggcggtctccgggttgcgcatcatcgcctcgtattccagtttgtctttctgctcccggtactcgttcatgtcgaaggtctgttcttcgaggatgccgtgtacgccctgcacgatggggcttaacacgctgttcatcgtacccaacacgatggtcgggaagaacaggatgcacaaaccgagcgcaaacgggcggagcagcgggtacacgtctatcgcctcggcgcgggcgagcgactgccacacgcgcaccgccacgtagaacaacgcgcccagcccggcaagccctttcgccacgcccgtcatgtccgcgcacagcggcatcatctcgtcgtagagcgaaaggagtatctggtgaaggttgtcgaactctcccataacttaccagtatttttcgttggggtttccgtagagtcctatcacccggtccatgtcgttcttcttccttgcccggaggtaggacaccgatatggtcttgttcgtgtagtagcgcacgaggttgcggtagttcatcaggctgcggtaggcgttgtcgataatcgccagccgttccgcgtccgtgagcgacatccccgtcacgttcaccacgttcttcaggtcttgcagcacgtccgaactctcgtctatcagcatggtgtagcccgacgatatggcggcaagctcttccggcgtgtagttctcatcagagagcatcttctggtagttatccacatagatttctgatatttccatcaccaacccgatgcttttcgacaccttcacgccgcccttcaccacgtcatgtacggatttcagcgcgtcgtaatacttctttccctgctcaaacactttcttggtttccaagaagccgttgagcgtgttggctttcgtgcccgccgtttccaccatctccttggcggagttgatgatgctctgcgcgaggttcgtcgggtcggacaccacccattgggcgtttgccgtgcctgcacctgcaaggcacaggcaggctgccaccaatggcattttcagtttttgtctcatattcacattggatttagtggtacattcttattgttctttcttcttttcgccattggctgtttcatccgtgttcacccggatatagtcgccgttaggcgaaaaggacaggatgtccgtttcctcgttgtatgccacgtcgatgcggaagcccgtgttcaggtagaggttaccgtccgcctccctttgcagcaggtaggtctccggcttcagtttccggtggacgcccgccctgcggaacagcgtcaccttgtaaagtgcgccctccttgtacaccaatatgtcgggcttgccctccacgctctgccagttgccgcaaatcttctcgcggatgtcttcgttttctttcattaccgtctcgcaggcttgcagcatcagcgacgccaagcctatcagaccgccgcaaagcagcagccgttgtgtctttgtcagttcaatgttcataatcttcaattcttgtttttttgttgataaaatgtgtcttgacctcatacgccgtttgatacacccttatatgccgtataaggtggcctcaaacgccgtctgtggtcgggtgatgtttccatcggttacttttcttcgtccatacgtttctccgcaatctgccgtatggcggcttccatgtcgctgcccagcttccccgccagttcgcggacttccatcttctccgtttcctccgttgtataggcaaggtattcgtgtatggacacctccgtggcgtacaccgccgactgtgtgccgcctaagcctatccacacctccttgtatcgtctggacgaatcgttggactggttgatggaaagtatctgcgacttctccttttccgtcagccccagcaatccctgtatctggtcgaagcggttcatgaacttccgctggtcgagcagtatcttgcagtccgagttgttgatgatggactccttgacgatgggcgagctgatgatgtcgtccacctcctgcgtcaccactattgcctcgccgaaatactttctgaccgtcttataaagatactttacataggaagccatattcgccgaagcaatcgccttccaagcctcttcaattattatcatctttctgataccttgcagacggcgcatcttgttgatgaacaactccataatgatgattgtcgtaaccgggaacaagatggcgtgctcttttatctggtcgatttcaaagacgatgaaccgcttgtgtagcaagtccagttccttgtccgaattaagcaggtaattatattcaccgcccttgtagtacggctccagcacattcaggaaactggcaatgtcaaagtccttttcacgcactttcttatcttccaataccttgcgataatccgtgtctataaactcgtagaacgtgttgaagcatgggacaatgctgttgtcttccttaatacgtcctatgtactgcgacacggcattggaaagtgcaacctcctccgcacgggtagcaggctcattgtccttcttccacagcgtcagcaacaaagtcttgatactttccctcttttcgatgtcatacaccttgtcctccgtgtagaacggattaaaggaaatcgggttgtcctccgtataggtataataaaccccgtcctttcccttggtcttgcggtgtatcatctcgcacagcccttggtaggagttgcccgtatcgaccagcaccacatgggagccttgctcatagtattgtctgaccagatggttcatgaagaacgatttgccgctgcccgaaggacccaatacgaacttgttgcggttggtcgtcacgccgcgcttcatcggcaggtcggagatgtcgatgtgcaggggcttgccgctgatgcggtccgccatgcggatgccgaaggcggacggagagtccttgtagttggtctcgcccgcgaagaggcacaccgcctgctctatgaacgtgtggaacgactcttccgccgggaagtccgccgcgttgccggggatgcccgcccagaacagcgtcgggcagtccgtcgtgttgtggcgcggcacacagcccatgcttgccatctggctgcccacgtcgttcttgatgcgtttcagctcctccgcgtcgtcgctccacgccatcacgttgaagtgggcgcggacggacttcagcccctgcgagtgcgcttcgttcaggtattcttcaatccactcgcggttgatggcgttctggcggctgtaccgggagagcgactgcatgttcctcgccgttttctcgaagcggcgcagttcctcgtcgctgttgccgatgaagacatactggttgtagatgtggttgcagggcagcagcagtcccagcggcgcggcgaaggacaggcggcagtccgagcggtcggtggacagcctttcgtaacggcagtccgtggccaccgctgcgggcaggtcctccgtgtccgacagggtgtgcaggcacaggcggttgtcgccgacgcgcatttcccttgccgtcatctcgatgtcctccagacagtccgcgttgcccagcgacagggcgaagtacctgcctatgatgcccgtctccttgtccgtgcctgtaagctcgtcatcggagaggcggcgcaatttgatatgccccgaatcgttcaggatacgcgcgaactgctccaccgcctcgatgaacttcaccgccgtctccttgtcctgtatttctttcggtacgatatgcccccggcacagcgtattccagttgctctgctgcctcatgcgctccttcgtagtcttcgtcaggaacaggtagcacttgtggtgcaggaacgggcgctcgttgaagtgcatctcgtagctgcgggcgaggaagcccatgccctccttgccgaggtcggggcggtaccgttccttcacgtaccagtcttgcttgtgcagcaccgaatggtcgggcagtaccttgattgccttgcaccacgtggcgtggatgccctcgtattcctccgccgtgacggtatagacctccggaagctccacctcgaaggcggcggtgatgtccgcgtctttcgagacgatgcacccgtgttccaccgaaagcagggggaagcggctttccagcgtggtggctttcatgatgtttctcatacgtttcttcctttcttcttttttcgtcttaacagattggacacccgtctgcggtggagcacatggcgtgggcgcatccgtgccgcgcccaacttcatcagcccgtgttcgccgtacttcgcgttcagccggaacgtgagccacacgagcgacgaggcggataccgcgccgaagccgatgcagagccactggcccgcgcctgccatgtagaggatgatgaagaggatgaaggcggcgagcagcccgcccgcgaacaggaacaggtactgcgccttcaggcccttgaactccaccggacggccgatgcccttgttgatggggtactcagccattgtccttataccttattatatatgtataggatacccgtttgttagaggaagaacgagcgcaggatggtcgcgcttacaatcaggaagatacacgcgccgaaccagcttgcggcggtcttcgaggtgtcggggtcgccggcgctgaatttgccgtacaccttgatgcctccgataagcccgacgaccgcgccgatggcgtagatgagtttcgtcgccgggtcaaagtaggaagtgaccatgctggtggcttcggtgatgcccgccatgccgttgccttgcgcgaaaacttggatgttggcagccagcaggagggccgcgaggatgatttgctttttcttcaatgtctttgtcataatcttttctgttttgtgcctccgggttggatgttcccattggcggttgatacttgttttaattcttgcggctttggatgaagccggcttttgggatttagtggtctcggtggcaagccgatggtttagccgtagtcgattttcttttttcgcattgctgttacgtttttacttgttatacatagtcgcggatgttgaagtcctcgaagttgtccggaactgcgggcgctttcttgggcataatcaccggtgtagtgtttgcctgcgccgccgacacggagtccagatagtagtccatcagctcgtccagtttcctgcgggtcgcttccgaactcttttctatcatcgcgaacagttcgttgcccttcatgtcgcagaacaccattccggcgtgacggcgttcctctttcgtggctttcggtttcttcaccgtccgcatggcaaggtcgatgtcctcgaaggtcatgcctcccgcttcatgaggctcgccgtcatcatctccgtcttcgtcatattccgccccgatgtcggaaacacgcttgtcggcaaacacctcgtccagttcctcgtcgggcacttggcgcgacggcctggctcccgaaagccggctattgggggaggcagtttcatcgtcaaaggccacgtccttctcgtccacctcctcgccgggggcttgcacggtggcattggacatcggtgcagcagcctgcggttttcgttcaggcatccggaacaggcttttccccatgatgtcgccggacctttccggtgcgcccacatccttttccttgtcctccttgggtacgttttcttcccggcgttcccaagtcaggtagatgaccatccataggttgaaggccatcatcagcacgatgagcagctcggccatcgtcagagcggttgcgaggtttcacggcgtaacagggcattgatgtcgtccccataggtttgcaagtgctcttccagcacattctcgatgtacccgccaatggtgctgccgttcccgcccagtgtccgcacaatgcgggacagcttcccgtgcatctcacggctgaggtaaatgcactggcggtgcgctccttgtctgggcgtcagatagcggaggaacaccgccgctttttctaattgggtgtcgtccacaatgtggatgactacgtccgccttttccagattgttcacttggggagtgtccgccttcgggttgccattccccttctttttcattctcgaattgaaaaatcccatcttgttttcgttttttagggtgaataaaatcaataaatgtcctcgtaatttttcttgtaaagtcggcggatcacttcctcgtattcgcggaagtgctgctccagcacacggtccacatagaccgacaacgtaagcccgttcttcccgatgacctgcacgatacgctgtatccgctcgtggtagcttttgcggatgtaggcggtcttgcccgaacacacggggattctcggtgcatggaggaagcgttccaggtattcctcttccttttccgtggcatccttgcccacctttgctttcggtttttccgccagcctggcctcctttgcggaagtgttgccatctgttccgaggctccccggggaggcgggcgcgggcatttccggacggaacgaatccaggaacttgccggggtcaatatcgacatcgagtttcttggccatcggttcaacgctttacgatgccgagtatttcttccgcgagggcatcgatgccgctccctttcgccaatgccttgtccggcggcagcagcgtggagcggaaaaacgggcggtcgccttcctcagagccttccttgcggaaacgcttgctgtcgggcagactggtgtccagcacttcaagccccatcccggctatcaccttgtcatagatgtcgtacaggtcggtcttctcgcgcttgtccaccatgttccacaagaggcggatgcccttgatgttcgacttgccggtagtgatcagcgtgtcgttgatgacgcccgcgtacttcagcgagctttccatgatgaaacggtctgcggctatcgggcagaagatgtagtccatcgtcgctactgtccggatcaggtcgaggttgttcaccgtacccgtcaggtcgaagaagatgaagtcgggcggtgtcgccgactcgacaaatggcctgaccgtttcaatcgcgttgccgggacggctccccacaatcgggtaggcgcgtttgccgatgcgcttgaactgctcgtatgccagcttgcgcaggtacgggttgcgctcgatacttttcaagtcgcgttcgcgcatgtccttgatgctgaactggggatagtcgcagtccacgaccgccacgtcatatcccttcacgtaatacaggtaactcgccatcagtacggtgagtgtcgttttgcctgctcctcccttctgggtggagaaggcgatgaacaaaggttcttttttcatgctttcttcttttttatttgttagacatccgtttcttggtccggtcggcagccatccgcccggtaagcgagcaggcagtccggcatccctcccggtatgcctgttcccatccatgcctgtgtgccggcaggcaagcataagggcaggcataccgaccattccgcctgcaaaggaaaatgactttcgccaaggttgtgtctctttgctgttgcgtggcagcatttggcgttgtcgtggcagcttgtggcgttctttggccaccctttccaccgcttttcctggcgtttggcccattgaaacggcatccgccctttgcctttccaccaagcctttgcctgtatgcctgtgtgccggcaggcacaagggctggcggactggcaggcaggttggcaaggatgtcagcccggaagcaggcaggcgtgccgaccgtttcgcctgcaaaggaaaggggctttctcaaaggttgtatccttttgccgttgcgtggcagcatttggcgttgtcgtggcagcttgtggcgttctttacccggccttatcgccactcatcttgcgtttggcttgtggccgttatttggcattttcaccattccgatgcctgtatgccagcgtgccggcaggcaggcacaagggcaagcagactggcaggcaggtgaactggcaggcgggcaagaatgcctgccacctggcaaggaagaatgctagcttgtaggttcgcaggcatattggccacaaataggtagaactttttctattgtggccaatgtggactcatgaacatcttaattcattcctaccaatcgctttccaatagttttcttgcttggctgattttcgctctttggcatttcagcactccaatgcctgtatgccggcaggcaggcacaagggcaagcagactggcaggcaggtgagcaggctggcgggcaagaatgcttgcggattcgcaaacatattgactacaaacatgaagaactctttttcacttgtgctaaatgtagtctcgtggacatcttagcacattcctccatcgctttccaacagtttctttgtttggctggtttatgctctttggcatttccccgctccaatgcctgtatgccagcgtgccggcaggcaggcacaagggcaagcagactgacaggcaggcaggtgaactggcaggcgggcaagaatgccttccggttcgcaaatctgaaaacggacaggcaggcaactatgtttttttcacttgcgtggcagcatttggcgctgtcgtggcagcttgtggcgtttttgagccgtatttcagacttggaaaacaccctacctttgcacccaagcggcagggcaaagccgaaagcgcgcaccgcagaccccggctccgtccttcttttgggcagcagaaaggtatcgggcgaccgatgccttataaatgggtaatggcaggtctatccccaatccgtttaccacggatttttgtgtcctcaaagacacagcaaggtgtcctttgagtaactcaaagggtttcgggttactcccgaaacgaccttgcccctcacggggagggcttcctctccgaagtcgggaagcctgtttccacctgcggtgcggttgccgaagctacgcttatgccgtgacaccactaaatccattgtaatatgaacgagaacaagaaaaagaacgggactgacagtcccaagtgggggcggcatccacgggaaagccgcaagtcgcactgcgtgatggtgcgtttcgacgacggggaatggctcaggttcctcgctatgcacggcaagtccggcgtggaggcgagggcggtgttcctgaaggcgcacttcttcggacagccgttccgggtactggtcacggacaagacgctgctcgactactgcacgaagctgtccgctttccatgcgcagtaccgcatggtggggaacaactataaccagacggtcaaggagctgcgctgccatttctcggagaaaaaggcgatggcattgctctacaagctggagcaatgcacgaaggaactggccgcaatcacgcggcaggtcgttgaactttcaagggagtttcaggaaagatggtcgcaaaaatcacggtaggcacgtcgctgtacggggcgttggcttacaacggcatgaaagtgaacgagggcgaggggaagctgctcgccgggaacaaggtcttcgacgatggcagcggacgggtggacatcgcccgtgccgaacaggatttcaaacggtacatgccggagaacgtccgcacacggaacaaggtcatccatatctcccttaatccgcatcccgacgaccgcctgacggacatggagatggaaagtctcgcgcgggagtatctggagaagctgggctacggcgaccagccttatctaattttcaaacatgaggacatcaaccgccaccacctgcatatcgtctccgtcaatgtggacgagaatggcaggcggttgaacaaggatttcatccatcgccgcagcaagcgcatcaccacggagctggaacgcaagtacggtctgcaccccgccgaccgcaggcagcaccgtaacgacaattccttgcgcaaggtggatgcctcgcagggagacgtgaagcgtcaggtgtcgaacaccgtcaaggcggtgatggctacctacaagttccggacaatgggcgaataccgcgccttgctctccctctacaacgtcactgtggaggaagcccgtggcatggtgaacggacgcgagtatcacggactggtctattccgccaccgatgatggcgggaacaaggtcggcaatcccttcaaggcatcctgcatcgggaagtccgtcggctatgaagccgtgctgcgcaggtttgagtatcccaatgcccaaatccgcgacaagcgtctggcggacatgacgcgcaagaccgtcgctgccgtattggacaggacgtaccgcaaggatgaatttgtcgccctgctcaaagcgaagggcgtggatgtggtgttccgccacacggacggggggcgcatctacggggcgaccttcatcgaccaccgcacgggctgtgtgctgaacggctcccggctgggcagggaattttccgccaacgccttgcaggagcacttcactttgccgtatgcggacacgccgccgatgccgttcacccttacacgggacgaaccgcaggcggaagcccatacctatgtggaacacggcgagagccattccacgggcttgggcttgcttggcggcgacgcatcgggcgcacaggcggaagaagccgccttcgagcgcgaactcaaacgcaagcggaagaaacgccggaagggtttgggattataaattatccgtccgcagggcatccaagcaaaggtcagacctttggctatctaaggtcagacctttggtagcctcacctcggacttgagataggctcaggtcggacttgaggtatgcttatgtccggggaaagccttgcggacatattgttcaacttaaaaacagaaacagatttatgtcacaacaggaagacgatttgagggcgttggcgaaaatcatggactttctccgcgccgtgagcattattctggtggtcgtccacctctattggtacgggtatgaagccgtaaggctgtggggcatcgacatcggtgtcgtggaccgggtgctggtcaatttcgaccgcaccgccggactgttccaccatatcctttacacaaaactttttgcgctgttgctattggctctctcttgcttgggtacaaagggcgtgaaggaggaaaaaatcacgtggggcaggatttggacggtgcttgccgcagggctggccctgttcttcctgaactggtggatgctctccctgccgctgcccgtggaagccaacgtagccttctatgccgcttcgatggcggcgggctatgtctgcctcctgatgtccggcacgtggatgagccgcctcttgcgcaccaacctcatggatgacgtgttcaacgtggaaaacgagagcttcatgcaggagacgcgcctcatggagaacgagtattcggtgaacctgcctacgcgcttctattacaggaagaagtggaacgacgggtacatcaacgtggtaaacccgttccgcgcttccatcgtattgggcactccgggcagcggaaagtcgtatgccgtggtaaacagctttatcaagcagatgattgaaaaatcttactcgatgtacatctatgacttcaagttcagcgacctttccaccatcgcttacaaccacctgatgaaccacggcgacggctacaaggtcaagccgaagttctacgtcattaacttcgacgacccgcgccggagccaccgctgcaatcccattcacccggatttcatggaggacatcaccgatgcctacgaaagtgcctataccattttattaaatttgaacaaaacttgggtgcaaaagcaaggcgacttcttcgtggagagtccgattatactttttgccagtattatctggtttttacggatttatcaggatggaaagtattgcaccttcccacacgccattgagttgctgaacagacgttatgaggatgttttccctattctcaccagctatccggagttggaaaactatctttcgccctttatggacgcttggcagggaggtgcagccgagcagttgatggggcaaatcgcatcagcgaagataccgctctcgcgcatgatttccccacagctttattgggtcatgtcagacagtgagtttacgttggatattaacaacccggatgagcctaagattctctgcgtcggcaataatcccgaccgtcagaacatctacggcgcggcgttgggtctgtacaattcccgaattgtcaagctcattaacaagaagggcaagctgaagtcggcggtaatcatcgacgagctgcctacgatttacttcaagggattggataatcttatcgccactgcccgaagcaacaaggtggcggtctgcctcggctttcaggacttttcgcagttgaaacgcgattatggggacaaagaagcggcggtcgtgatgaacacggtgggaaacatcttttcgggtcaagtcgttggtgagaccgccaaaacgctttccgagcgtttcggcaaaatcttgcagaagcggcagagcgtcaccatcaaccgggaggacaagtccacctccatcaacacgcagatggagagcctgatacccgcgagcaagatttccacgctgacgcagggcatgttcgtgggcgcggtggccgacaacttcaacgagcgcatcgagcagaaaatctttcattgcgagattgtggtggacgtggagaaggtgaagcgcgaggaacaggcttacaagcccatccccgtcatcacggacttcaccgatgccgacggcaacgaccgcatgaaggaaatgatacaggagaactacaaccgcatcaaggcggaagtgcggcagattgtcgccgacgagttgcagcgcatccagtccgacccggaactgcaacacctcttgcagggcaagtaaaaacgccataggcgaaaaaaggaaaatccttaacttggctggatgttcagaccgggttaaggattgtccttttctcgttgattgacaattgaaatgaaaattactgcattggtttctccgttttatacagcagatggggcatttcttttccattgtatataatggtatggctgccgcaaggtttcatggcaatggcttccgccacacggatggaggacgtgttttcgggacggatgctgcaatagacctcttgcaagcccagtttctcgaaagcgtaccgcaggcatcttcgggcggcttccgtggcatagccgttgtgccaatacgcattgtccaggatgtagccgagttccaccgcttcattcccgtttatcacgcttttcatcagcccggcctgtccgataagtttgcccccgtctttcaacacaagggcgaaatacccgtagccgtccttgcggtaacgggagaactggcggttcacccattggcgcacctccttcttgtcaaagccgtgttcccatgcgtacatgacttccgacttgcccatgagggcgagcaacgcgcccgtgtccttgcgggtgattttgcggatgacgagccgttccgtttccatgatcgtgagcgactcggcgtaggtctttatctccaagccgtcgtctttccactccttgaccatcttccggacggtatcatccaccagcctgcggtaggcgtcatcgggaacggctttcaagtaaaacgtgtcattggtttccttcaacacccaatcggctatgtcctgcaagtccttcccttcggggatatagtccttgtgtatcatgtactcgttgatgttgtcctccagtagttcctccatggcggtacgggtgtcttcctccaattccgaaaacggggtttccgctacctgaaaaatgtcgttgttccattcatccgcttcttcatcgtcctcttccggcacaaaaacgccccgtttcatgtccagcatctcctgcgcgaattttcccgactccctgtccttgtacttcttggcatatttttccagcagttcccagtcctgccgcctcatggggaagcggaacgcggcgcgttccacctcgttgcagcgcatcatgtccgcctgttcgtcctttggaagcgactggcattccttgcagatgtgcagcgcgtgtcctctgcccgagaagctctcgttggacttgtggcagccgcataccttgcagtagtgtccgccgtgtttccttttcttcttcaccatgttactcacccctttccagcaaagcctttccttgttcggtgagcctgtatttctgcttgggatgtttcggctggtcaggatagagcggttccaccaatccggcttccatagacgggttaaggtaattgcccaagaaattctccctgtccttcagttccatcattcccatcatttctttcagcgagcaagtgtgttcccctatcagttcaatgagccggacgatgcttgtcgggtacttgtcgggtgcttgtcgggtacttgtcggatgcttgtcggatgcttgtccagccgtttccatctcatagcggaataccacccatacggaactcccgtccgtgtggaattccgggtcgggtatgccggcacggcggcactcgtctatcatcaggctgatgccgcgaccccagctttccagcaactcgcttttgtaaagcacgttggctatgatgaggttgggcggctctgaactgtgtccgccaagcagtttttcaagggtcatgtcgggagggaacgcgccgctgctctctatttccacgcggtcgtcataaatggcgatgcccaccgaaccgcccggacggtggtaggctctgtgacaaaaggcgttgatgcaacattccctcaatgccttgtaaggtatgctcagcttttcttcacggtacagcccctctattttacccgacaaggacaggtgcttgaaaaaaaacgacatggcagcgtccaatagcgcgtagatgttcccttgctgtctttggttgtctatgaattcctctttgcttgtgcctctgaaccttgccattcgcaacaggcattggggatagtcgtacagattgcgcccgaacagtacggcggcggcattgttcagcttcccgtcatgcaacaggtcgaatttttcaaggatggcgggtatttcttcgcgaatggtggtttccggcaggcgtccgcagttgattccggcgcgtaccgcaccgatgatgacattctcgtcgaggtcgctgatttgcaggtcggggttggggattgcctcccaactgtatttgccgcccctttgcatcagcaggtggttgtacttgtcctgcggcatgacagacgtcacgctttctatccgctggtaagccctgcctttatatgtgaacggacgcatatagcgttgttcctcagcatataaggcaatgacctgtttgtccgtgtcgggaatgtttgcgtatgagaccgttatcgtggcaaacggctcgaataggcggatggcttccgcaatttcccgtttcgtcttgtcgctcacttcctgaccggtgattttcccgttgtcagccacgccgaacagtaccgtaccgccctcgccgttgaggaaggcgcacagtgtctccatgccgcgctccaactgcccggtgatcagcttgtattctgtccgtcccccttcatcgccggaggccagtttgcgtatgtcgtctatattggttatattcatgcgtaatcgtttggagggcaaaaataatcatttgaccgacagatacgaaattttggagcattttcttgcaaattgtcattgctagaacaggaaaaagaaaccgggagcaaggggcttctacccatacaccttgttcccggtcatgaatcagacagaaaaactttcatctcttgcgtgcccgttcccgctcatcgtctttcacgattcgctcgttcagcttttcggaagcccggtcgaagaaataggtacggctgtcatttttccgacgacggatatccacataggcgttgtagcactgactgggcttcaactccatgccgaagaatcgggagaaatggaccatcagttcctggataccggtttctccgccgttgatacatttcagggtgtcgagcccgtacaataattccactaggtcggatatgctgcctgtccaacatatcggaggggcatcagaaggaggggcgccggttttctcgccggtaaacatgtgggagggcggcaacggatggtattcccgggcaaggaaccgtagcatcttgcgcacaaaggcaagggccttgtgtacatgcagattcagttcgctctcatggctcctgccttgcagggcctcatggtattgcagctccgtttccgcatagctcagggcgtgtaccggatgtccgctttcgggcgggatgagacagagttggatgaccctttgtgtaaactcatcgtaggccgtgcgtaacccggtgcggctgtcgggattgcttatcagacggaaaaactcggtttccgtcaaggtgagatgttccatttgttcctaattttttgtttttactcggatgaaatgtgcgcacatacatccataggagcaaatgatagtccaattacaatgttatggtgatgaacttgtatgcaatttcttgcaaatcaagctcttggcagacgaaaatttgttttaaggaagaataggcagcctccttcccgtgtccgacttccggacaggtgtccgtttttcgtacacagtaccgccctttctttccgcttttttccattccgtttcgtcctttcccctgccatgtcacctcttcgtctgaatcccatacaggtccattttctcgtacagcgtgctccggcttatgcccagcagtctggcggcctctttccgattatgcccggccttttccaaagcctggcatatccgcttcttttccatgcattcccctttcaaggcaatgtcaggatcggaaggctttccggactcatccaagttcaattcttccgccgtcaccaattccccttgggcaaaaagcacggcggattggaccgcctgtttcagttcccgtacgtttcccggccagtcatgggccagcaaccgtttcttcgcctccgcatcgaaaccttttacctgtctgccatgctcttggttgtaaagttcccggaagaattcagcaagcggcaggatgtcttccgggcattccctgagcgggggtactttcacggtgtactcactcaatcggaaatacaggtcccggcggaaacgcctttccgatatggcttcttccagattctcgttcgttgcggtgatgatgcgcacgttggctttcctgtcttttgtgccgccgacaggacggtaacgcctgtcctgtatggcgcagagcagcatctgctgtacgccgaggggaaggttgcctatctcatccaggaacaacgttcctccctcggcttccgaccaatagccttccttgcgcccgaccgccccggtaaaagcccctttttcatgcccaaacaaggcggaagcggccagactttcggataacagcccgcagtccactgtcacgaacggtttgtccgcacggtcgctttgggcatgtatcttttcagcgatatgtttctttcctgtaccgttctcaccccgaaccatcacgcagatgtcggctttggctaggacgtggagacgtccgaatactttctggtaggcttcgctctcccttatgaacaggggttcctcatggaatgactgccttttctgcaagtcttggagcatggcgggaagctggctggtcagcagtttcttggggatatagtcttccgctccggatttcatggaacgcacggcggtaggcacttccgcataatccgtcatgatgacgtagggattgtgcttcccctcgcggcgcagttcttcaagcaacaggatgccgtcaccgtcaggcaaccggaggtcggcaagcacgatgtcgtcatcttccagcattgaaaacagtttccgggcaccggtgcaatcggaggtactgactgtccggtatccgttttcttccaaaaaattgcagacatacctgctgtacacaaggttgtcttccactacgattatctttcccatttcttcatctcctttctggcggcttctatgatggtttctccttgttccaacacggcacgggctgcataggcgacttcttcgtccgagtacggttccttgtggatggcttcgtgcaacttctgcaaggggcgttccgtccgtatcaccatccatgagctcctcaaatggtgtacccagctgttcaaggctgtcaagtctttcctttcggatgccttccggacttcctctatctctttctccgtttcggcaatcagctgctccaatgttttccgcttgtcgccgaaagccaacagggcggagaagtccggctgccggttccctctttcacggatgcagtgccgtgtcgcctccatcagttcgtctatggaaaacggcttgggaagcaatccggaaaatccggcttctttcagttcctcctccgatacatagccggccgcagtagctgccacgatgggaagttcacgggaattgccgatgtcggacatgcgcagcagttccagaatctcgtagccgttcgcttccggcattctcaagtctgttatcaacaggtcataatccttgctccgtatcctgtcggtcagctcggccaacgtaaggcagttgtcgcatgaaacgccacattgaaggtacatctcgcgcatcaggcggagcgtcaccgggtcgttgtctatggccagcacggaacatccggccagtgaaggacggacatccattgacttctcttcttccggtacttcttcggctttcggcagcggcaggacaacggtgaagcggcttcctatgccaggtttgctctgtacggaagcagaaccctgcatcagctgtacgagattggtcacaatggcaaggcccagcccgaagccgtcctgagtcacagcattgcccagacgttcgaagggggcgaaaatctgttcctgcttttcttccgggatgcccgtcccggtatcctgcacgtacaggatgaagttgccgtccttatagtccgtgcagagtgtaatgcgaccgctgcgggtaaacttgaccgcattggagagcaggttgcttccgatgcgcaatatgcgctccttatcgcctcccagcacttctgtcgtctggttgtcagtcacgaattcgattcctttggcttcagccaaaggggcgaactccgtttccaacacagttgctattgactcggagcggaatggacggatatgcagcttttctttatggatctccagcctgaaaaattccagcagctcggtggtcatggaagccatgcggctggcagattcacgcacggttaatatgtggcgtacccggtcttccagggcttcatcccggagcaggagttctgcattgccgcttatcgccgtcagggccgtgcgcatttcatggctgacagtctgcatcaggttgtgacggaattgcagcaattgccggttcttctcattgctcgcctgcaattcgccgataagttcttcgcgtttctttttttcgccatgattgcggcggatttcccggtggatggcgatgtggaacaggattaaaaggaggatggcggtggacaaggtagaggtgagcaggagcgtggaacggctttgcgcttccattatcttatgctcacgctgaaagaaggcttcctgcacttgcctgtccagattcttgatgaggtggttcagccgggcgttcaatgccagattgcgggcgtacaggctgtcggcactggtttccatatcctccgtcccttcctgctgcatggcaatcaggctgtcactgaatgcgtgcagttctccggcggaaggcaaaacccggacggttttcttggcgcccaacgctcccagtatattgtcccttcttttcctcacggtgcgtatgcgggtggcacgttccgccactttgggcagatggtggacaagcagactgtcagcagcatcctgtatcccgatggcttccacgacacggaacaagtgcatttccttgtcggcaagcaggtgccggagcgtgtctatctgttcgggacgtacatgctgcctgcaccggggcttcaaggccagcagcaggctgtctgtggacagccgtttctggcgatagtttgccgtatctgcattttcttggctgatcaggctctcgcccagcagggaaagctcggtgatgtgaaggtgtgcggcatggatgtcattccgtaccgattgcaggtcatgcacttcgaaatctatctcccgcatccggctacgctcacgaaagaggataaccaccattccgactatggcggccagcaacaggaagttcccggcatatatcttttgtgtcaaggatactttcattgctagtcatattatccgtagtgcattctctcatcagaatgtgctacctcgtttatgggcaaaaatagaaattatcaaccacaatccatgcgaccggttcagagtttatgaataattatttttttagaacgattcaaaacaaattgagccgcaccatgacgggtgtttgattgtaaaatagtcattgggattatgcaagcgtaacgcaggcatccgaacgaacggatattacaacatccggcaagagtgcagacaatgcaaaatgcacagagagtctgatagacaatgcaactacttgcatacaggtacaacaaaacaatggcgactacaacatttgggttcatagttgcagtcgccatttcacatgcaaaggttgtacctgtggttcccgaaaacttacgatttctttcctgcttcggatacagctacaaaaatagccgtcctgattccgggcggctattataactacttgcaggtaattgcagacagtgctttttaatatatctgtctacaaggtgagaaacaacaatcaattgtcactcgtccctccattatggtttctgttgtaagaggttgtcacgactgccacatcaccgtattgtcttccactgacggaacggttcaatgcggagacggtcaaagtggtcacttgttgagtacctgccacgtgcaaggccgtaccgacgggcaaggtcacattgatggggtaagttcccgtagccgtagtgacacctgcgccggcaatgcgggccagaatctcaatcaggtaagcggttatccgactggtcccggacgaagtgatttccgttccgatgtgataagtgaacgaggccgaaccaacggtcatgtcacccgatccatacaggttgtcccacaggtcttgttcaaaggccaacggcgtgcttgtggaggaagaagtcacatccgctccaaagagcaacgtataggaagtgaactggtcggcaaacacgattacttgtccgccttctacagtatattctgcatccacccattgcccgttcacgtatttctgtgccgtgatggattgcgccacttccgcatccacatcgtaagccaattcgatgggacttgaaagcgtggcgttcgcatcggtgcaagccacgcttgtaccaatcagcatgacgctttcggcagcacgggaagtggcacgggtattggcttcggcttcatccagcgtgtaaagcggggtaaccacgatggaacttcccgcaggcaattccgccgtctcgggtacggtgacagccactgtgaccgcgccctcgtcattgccttcgatggtctctgaagtcacgttggcctccgtatcgccgttggcggctacttcaatggtcgtgccttcattgggcaatgacacgttccatacgacattggctccgcttccgctttctgcaacggtgacggttgtttccttggactgtttccccggagcggaagccgtcagggtataacttccggcatccacatcgtcaaaagtgaacgtgccatctgcgccggtctgtgtcgattcgccgttcatgctcacggtagccgaaaggccgttgccgtccatgccggtgacacgcccgctgatactgtgcgatacggacaccgtgggcggcgtcacgttgctgtaatccggatcatcgtcactgcaccctacgaaactggtgcacaaagccacactaaggaatgcgaacattccccatcttgatagatttctaagattttccatttctaaaaataattaaacgattaaattaggttattttgaaattctgtattctagtagttatatccgtattgtttgtgtcttcaatcagggtgggtcttgcccaacaggtttaacttgaaacacaggccacctgtgaaatgtttcccattctgcaaggttgcctgcaaaaagaggtgtttccacaacaaacagtctgcgccgatgttgatatcgtcaccggtatattctatcgttgcccgaaggtttctggcaaaggacgggcgataggtgataccggcggctatgccccgccatttggcattgaaatccgatgtaaaatagcggtaggtcaaatgaaaaccaaattcattccgcctgtacatgacgtgtttgctggcggctatataataattctggaagtagtcgttgaccggatatttgccttcggcataggactcgttcaccttgctgccgggatcctgggtgcctatggcaattgcaggccaccatttgccttctttcagcggacgcactttcaggtgaaagtaccggtctttcttattatgtccgacatggccatcgttgtcaatccccttcagtatggtacagacatacgctatttctatccaagggaagggggtgatggccagaaaatggttggtcgtgttgaatttctctccttcatactggtaggtgtcaggaagaaattcctgattcaggaagaagaaaccgatacgggcttctccctctgtcgccatttccgccgtgggcacgtggatcatgccggtaacgcccgaatactcttgcgccctcaatatcggaatgcagcccatcacgacaaggaggccaatcaataatcttctcatttccgccctccttccttttccgagaagtccggcttcatggtgttgctgccccattgcagggcattgcggtcaaaccagccctcgcgttcgttctcctccgggtcggtcgtgtacattttgttggcataggcgtcaccttccatactgtatgtcaggcggaaattagaagccggacggaaattgacagtgcgccgtttccgcttgtaaggcggtatcatcatcaccaccttaaaaccggcattcttgccgccctcgttgctatactcgccgtacaatccgaccgtacagtggttgaaatgccgcatggcttcaactatggctccataatcttcatagaggaaacgtccgccccttgcgcggaactgcgtattccatttgttcagatagacatcggtgcccagcaaggcggtaatccgtttgggggtacttgcttcccagtccactgccattgaacaatagccggttaatccagcctgcacttccaatgccaaccagcggtttacgacatacatccctttcaagtccaatccataccgctccctgccgaacaagccgccgcttgctttcaggaaccaccgggatcgccaatgcgcctctttagataacaccgccatgttcaaccgtactttcttgtatcggtcgccatagtcgttatacaccggcactaatgcctgtgctgccgcctgccaccccttgcccatgttccatttcacaccgggagtcagattcagcaaaatctcatatattttcccattgtgaaacaaatcccggtagttgaaatccgcccctacaaatatatctacctgaccagcgggtatggacggctgtgcaattatggatgaatacccataaaagaccagcatgaatagcaaaatgaacagtttcttgcttattctctcgtaagctttcattttttcatatacgctcgtaattgttttattgttaattgatgtcatagttcatatcccggtcatctttcatctgataccttttaccacattttctacgaaacgcaagtttctcttcatccttttaacccaatgtgagccatcctgattttactctaagatggctcacattgaaacgacactcgcacaaagtgcctttcagtctttcaccagaaaagaggtgaaaggtttatttttcccaatcatttattcacactttcattagtccaaatataatccttcatgataaaactttgttttagcttccaccttaggtcagtttacaaggaactacacgcagaccgtgaaacgggctgctgacaacaaacggcggtatgctcccggagagggcagcataccgcctgttttgttgtctagggtttccaaaggggtgccccctttggcacacgactttgcttgcaaagtgtagtgtgttatacctgctggcgtggctgacagaggaaacggggtgcggtgcttcttgcaccccgtttgctccggcaggaaaacaggctgaatttttgcgaatgggaatgagcaaaaaatcggcctgttttcagagaacggcggcaggtatatgaaagcccccgtccctcgtccttcgctccgacttgtggacaaagtgtcccgaagtgtggccacactcccggaaaagtagcaggacagcaggcaaccgtcaaggctgaaatgaacgggtttgcacccggccttgaccgccgcccgccgttccgctgaatgggtgaacaaggcggccaatcctcaaagtgcttgaccgctctctttttgattttggagcatttcttttcccaaaattgaaatgggcggggaaaccattttagggctttcccgccttgattaccctttagcaaagacgggcggggctgtcaacggcggcgcatgaaatgcgccgttcatcttgaccgttgactggctcggctggctttgctatttttatcgaattgcatattggtaaattgcattgatatgtacttgggttgtattcacgattggcacattaacatcttcgggctttatggcaagtggcagctccgtacaggcgagaatgagtgcatctacattttctttttcaatgtatttatttgccagtgcaatcattttctctttatcactaggaattactatgccattctctaaattggggtatatcagttttcctaatagagatattattttttcgctatcgcctttacaagtaacatcatcgggcggcgaagttcatcttccatacccggaatatccatcatctctttaggcggttctgcttcctctacaactttaagctcaaacccattgttcagcaatcccattataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcttcctctacaactttaagctcaaacccattgttcagcaatcccattataatctgtgtaagtgtgtgatgttgttttactacatcacatcctaaaaaatgtgtatttcgttctcctgttataaagtaattatcaatcgcccaatattgcggtttcccatcatctgtataaatccaatcctgcccaactcctgcggtaaaaacagggtgttcgatattaaaaagaaaaattccacctggttttaatgtcctatacactttttgaaatatttccactatgtcctctatatagtgcagagctaaattagatataacacaatcccattcattttctggatagtcatattcctctaatccgctaatacgatattcaatttgatttcctgaattgcgcttttgggcttcctcaatcattttcttacttaaatcgatccctaatatttttgtagctccttgttcttctgcgaacttgcagtgccagccatatccgcaccccaagtcaagaacagattttccttctaacgaaggaaacaaaggttttaattgatgccattcaccagcagcttttaacccctctttatcaatgacaataacattcccttgtgtttcttcaagaattgctgatcgcaaactcgttttccctgaccctggttgcccaccaagtaaaaaagcggttggcgattcaaccgctttttttccttgaaccaattcttctaaattatcatttaagcgattttcaaattgtttgtcagtaaaattgactatatttgccatattaagccactttctctttattcaaaacttgttttgaatagcgattcattgaccgccaatactcatgaacggcttgtaattcttctaaagaataatcaaaaagatttacacgttttgcaagctttaattggtttaataaattgacttccaataattgagagtcatttttatttaattcatgattcaaaacatagtttaatactcgattataaacgcttgccgataattcgttaatgatctctatttcaaatgttttttcataagtaactgccatttcattttcactccttttaaagtttgtcaggtaaatatttccgaatatattcttctaaggctttatccataacttcttttacgtttccgccattctttgctgtttcgatttttataatatggtgcaagtcagcacgaacacgaaccgtcttatcccccataatatctttttttgcactgattggtgtatcatttcgttttgctttttgtgcgcctaaatttcccacaaccactcacttctttctatttcttcttactcttattttatcatcaacaatcacaaatcacaagtgatttgtgattaatcacttgtgatttgtgattctattctttttcgttttctaattgaatgattcgctcaagcatttcaaaaaatacgttctcatacatagataaaatcaatatatcccttttctccgatttttacaacggcattgtaggactttctatctttcgttttgattccttttaccagggtttcttttccctctagtaattcttttacatttgttttggtgagttttttctttctaaaatgttcagctaaagtgaaggtacattcaggataatttgaacaaccataaaacgatttttttaatacaatattgttgccacacttaggacattttcctacaaggggtcccgagcgcttagtgggaatttgtaccccttatcgatacaaattccccgtaggcgctagggacctctttagctccttggaagctgtcagtagtatacctaataatttatctacattccctttagtaacgtgtaactttccaaatttacaaaagcgactcatagaattatttcctcccgttaaataatagataactattaaaaatagacaatacttgctcataagtaacggtacttaaattgtttactttggcgtgtttcattgcttgatgaaactgatttttagtaaacagttgacgatattctcgattgacccattttgaaacaaagtacgtatatagcttccaatatttatctggaacatctgtggtatggcgggtaagttttattaagacactgtttacttttggtttaggatgaaagcattccgctggcagcttaagcaattgctgaatcgagacttgagtgtgcaagagcaaccctagtgttcggtgaatatccaaggtacccttgtagaatccttctgcaacaatcagatagatgtcagacgcatggctttcaaaaaccacttttttaataatttgtgtgcttaaatggtaaggaatactcccaacaattttatacctctgtttgttagggaattgaaactgtagaatatcttggtgaattaaagtgacacgagtattcagttttaatttttctgacgataagttgaatagatgactgtctaattcaatagacgttacctgtttacttattttagccagtttcgtcgttaaatgccctttacctgttccaatttcgtaaacggtatcggtttcttttaaattcaattgttttattatttggttgagtactttttcactcgttaaaaagttttgagaatattttatatttttgttcatgtaatcactccttcttaattacaaatttttagcatctaatttaacttcaatagactaataacaatgtttggtcttgcttcactttgtgcttgtcggaagcctaaatagtaactgcgttttgcttcgtgtccgtctggcaaccgctcaaattgttcatcaagttctgatacaccttcttcgttatagcgtggatcaaattcttctaaaaagtctgcttcctctacaactttaagctcaaacccattgttcagcaatcccattataatctgtgtaagtgtgtgatgttgttttactacatcacatcctaaaaaatgtgtatttcgttctcctgttataaagtaattatcaatcgcccaatattgcggtttcccatcatctgtataaatccaatcttgcccaactcctgcggtaaaaacagggtgttcgatattaaaaagaaaaattccacctggttttaatgtcctatacactttttgaaatatttccactatgtcctctatatagtgaagagctaaattagatataacacaatcccattcattttctggatagtcgtattcctctaatccgctaatacgatattcaatttgatttcctgaattgcgcttttgggcttcctcaatcattttcttacttaaatcgatccctaatatttttgtagctccttgttcttctgcgaacttgcagtgccagccatatccgcaccccaagtcaagaacagattttccttctaacgaaggaaacaaaggttttaattgatgccattcaccagcagcttttaacccctctttactgcgggacatctttgcatattcttcaaaaaacttctcattatcgtattcattattcataaccttaacatctcctattttatccttcggcaccgccgcctccaggcggctccccaacttcatctgctcgataaatgggaattgcaccaaaacaatctaagacaacaacgctgccctacttgcgattttttcttgtactgcggaaacagtttcttgaatggaataagtggtcgtatctataacattcgattcatatattcccagattgcaaaattgctcccacatggtttctaccaattcgatatttgtctttcggtctaactttgagcgttcaacagctcgcttcaaggtttcttccttacttgcccttaaaataatataatgcacctcataatgttcccgaacaagactttgccacggctttaaaaaccacggtccgataataccgtcaacaattacatcatatcccccacgagcatatcgcttcgcagcttctaaaaacgcttcaatgacaatcaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacgagcatatcgcttcgcagcttctaaaaacgcttcaatgacaatcaaattttgctcatttgattctggtaaatgcggtggtattgcccctttactcaaataatgataaaagtcatctgtgtgcatatgcacagacttttccaaatctgattcttttgcaacagcagatgccgttgtagtttttcctgtccccggcgcacctgtgattacaataattctaccttgatttatctatattttacctccacaaattccgatttgactatctcttaactcgttttgataaatgaagttcattatcatctacatatccaagtttattatatacagtttgtgcaacaagattttcttgtcctgttagaagttcatattggtgaagtggataattcttactacaataagcctctgcaaaagtaatcatctcactcgctaagcctctttttctgtatgctggtttaacatacacttctgtaatttcaggcatatattcatcatagcagaacgattttttaagctgaacacaaacaaatccaactaacatatcatcttcatcagcaacgataacaacttcctgtttattattcataagggaatttctaatattgtctatgcttgtttcgctctcaccattaaattcatcatttaagatgtttaattgctctgcatcatttactgttgcaattcttaccataattacacctcatcaaattccgatttgttgataactcattatatcataaatctattcactgtatcataaatctatccacttttcaatctatatcacgcaattaacttggaaaggaacaccgccgagcaatgggttatctcggcggtcactcttttactcgttgtccgctccatacgataccgacgacggaattccgttatcatttagatttttctcgatatccttcaccggaagtgaggaaaaatacgcttctcttccctcttttattataagctcgtggcacggcttgtttccggcgttgtcgggaatgcgcgcgtccattatgttcacggctatcatctcgggagtaatggcggctctccctccggcttgacctacgcacaccaccgcgtcgggtctgtattgctccaccgcttttttaagaacctctcctgcctttccaaacaccgtcggcacttcgagctttaaaatttccgcgccttgtatttcgtttttcatcatttttacggcttctcccgcaggattgattttctctcccccgaacgggtcaaagcctgtgaacagtattctcattttatcatgcctttctttgtctgtattctctcaaaatctcgcggcacctgttttgaagccactctgttgtctcagtatcgttttcgacagcgttttcgtatatttccgtcatccctatccgcagctcatagcataaaattcgctcggtatatctcggcaggtgagagtattttctctcccaatacgccgcagttttttccatgcacatgagccatgtccgccaaaaatacgcggtcgcgatgtcgtaaagaaagtccccgtaagccgcgcagtcccagtctataacgccacttatcctcgattttttgcctacgataacattattcgagccgaaatccccgtggaacagcgctctttcttccgggcaataagatataagctcacgatatgccgcgagaagctcgtcgatgagtgagaggttaacatagctcctgcttaccgccgtccagtctctctcgaatacctccgcaagatattctctccagctgtaaaacggagcgtttcccgtatcgctgtcaaacacgccgcagccggaagtgcctgatatatcggttcgcgatattgcttcggttacatccgtaatatcgccgagcagtcgcacaaccgtttcttcatcggagtcctcatatgtaatcccgtccgcttttacgctgatgcagaagtagtgcgtgccgtcaaagttgcctgtttcaacaacctctggaataggaactctatccgagcggaagtgctcataggcgtatttgtcttttttgaagccttccatatttgaatttatgcgcacgacatattctctgccgccacgcgaaaaccaatacgcctgtgactcctgcccttcttttatcggaaaaagccttatatcctcaccgtactttcggcttaaaaactctgtgatgctttcttttgaataatcgcttttcatgttccgctctctcctttagctctgtctgaggataatataccacaaaaaagcaaaaaaatctaagacaacaacgctgccctacttactattttttcttttactgctgaaacagtatctttgattgaatgcgtagttgtatctataacatttaattcatagattcctaaattggaaaattgattccacattgtttcaactaattcaatatttgtttctctgtctaactttgagcgttcgatagctcgcttcatagtttcttctttacttgcccttaaaacgatatagtgtacttcataatgctcttgaacaatgttgagccacggctctaaaaaccacggtcctacaatgccatctacaattacatcatatccaccacgagcatatcgcttcgcagcttctaaaaacgcttcaatgacaatcaaattttgctcatttgattctggcaaatgcggtggtattgcccctttactcaaataatgataaaagtcatctgtgtgcatatgcacagacttttccaaatctgattcttttgcaacagcagatgccgttgtagtttttcctgtccccggcgaacctgtaatcacaataattcttccttggttcattttcactcctcctatttcgatttgctgttctctatttctttttccgtccccgctgtgggtttggatttttcggcaagtccaacttctccgcaatctattttagccgcttcttttcttcttcaaacagtttattataccccaaaaccataaatcagcaaacgcaaaaaccgttaccaaagaaaatgccgcctgccttttttgctaaacctaaagaggctaagttagaagtggacgcactatacaaaggaatactaccatttcgtctaactgcttctgcccattctgcaagtgtgtggaatgcatacccttttcttctgtaaagttcagccgtttcaattcccgcttcctctgcctcaagaataatccgaacactacgacaaatagatacgacttgagaatcttccaaataagcagcgcaaaagggaacatccagcaactcttcaggtagccagggaaaatagtggctcatctgaggctcaatgttgtctttagtgagtaagcaggcttttaactttggctgttcaggaagccaaaaacaagcatcttctgaaatcttactttctcctaatagttgccgatattctttatcataaataggtgattcattcggcagcatcagtactggctctctgttggtaattgattgtagtttttctcttaattctttcggtacgtcagcgcgaaaataagcatgtggtttttcgtaaagtggtcttgtcaaatagaagcggggagccggctgtgaagtggagtcccatggttcccttatagtcataagttcgttcttttcattcattgtaaacagtgcttctacatgaagctgcatatagtacgagttgctttttcccattttctaatattctcctacatttatttctctgcctgttcaatcattttctttactaaccgctgaaacaggtcggcggtttcctcgtccatcggtgcaagctgtccgatctgtccagctatcatcgccgttacatcgtcaatggaaagcggtttttgtttctgttccgccagtgcgtcccgcatggcttggaacatagcggcggtcacagcttctcccagctgttccccgttgtcaatatctttcttaatatcccgcaggatagccaggatttgttgctcgatgccagggctttcaatgcccgagttggccggaagcagctggttcttgctggtggaattggtgaggtaattgcggatataccgtgccatggaaagctgcgtgttcaatgccagaatttgcgcattggtctcgctgctctgttccatatacatgctggcagcggcctgtacatcgggcagaaggtgttcgctcttgtaagaggagatgttttcatccacattgccaagttcctgctcaatcacaccgagacggtcactaatgaaagccgaggtactaactgcgatttgattcttgtcctttatccagttctcattgtaaacggctatcaccgtattcagcacatcctccgcccgttggatgcacacgtctttgaatgacagattgatgacagtggatttctcatcactcaacgtaactgacaagttggaagcatagtcgcctgtggcatcttggtatcctctgcgtgagacataaacaggtgaatcatgggtggcggaatcgttcgcaacctttacaacaagttttccgataggggcgtcaactgtgtcattcaacacagccgttatctttcctgccacatcttcaccattacgagaaaaatccgtcagaagtacttggccatcaagaccggggttaatggtaaaagccacgctctcgttgtcttgcaattcgttaaagtctaccgtgtaggggcaatctcgaccatacaagactttcttgtaaaaccctccgtccgtgtgataactgatgtccaaatgaaggcgtttcaccacatcaagcattaccgcaggagactgcaacgattgtatttcattgtttacgttggtgttggtctggaagaggtcgaagtctcccatcagaccagccgcatcacccaatgagttccctttggaatcctctttgataaggagcgatgctgaacgggtatataccggcggggtggtcaaaagatagacgacagccactccgacggtaacagccaacgatatgacgaaccaataccacttgttgagacagaggtagaacaaatcttgtatacggataaagtcatccgcctgtttaggtttggatatattgttttgagttgccacgatatacaatatttagattggacgtgattaattaaaaatgaggatggccacagaagtcagcaacgatgccagcgaaatccagaacgaggtggaacgcacgttgttgccgttgacggtagattgacgggctttcacttcattgggttccacatacaccacgtcattctgttgcagataataggcgggtgaagaatagatgtgttcgccggaagtgaggttcagtccgtacacccgttgcacatccccttcttgccgtaacaccatcaccttggaacggtttccgtagatggtcaggtcgcctgccatgctgagtgcatcgagtatggtcagcctgtcccggtcaatgctgaaacgtcccggactgttcacctcgcccaacacggatatgcagagattggcaaattccacggtcacgacagggtctttcaccaaattctcctttatcaattcgttcttgatacattcggcgatttcttcccgcttcattccggccacgtgtatcttgccaagtacaggaaaatctatcttaccgttggcatctacggtataagcggatactccttgattgcttgaagccgtcacgccatttgtccttaaagactgacccaattgcctggacacataaggcaggttgaacaagtccgtcaactgggggtcacggctgttgacgataatggaaatcttatcctccggtcggactgtaatggctttcacttcaggcaacttgatttctgtttccccgggtctcaaatcctggaaataaactacttccttggaagaaccgcacgagcccagtgtcactgtacttgcgacaatgagcaagatgtaaaatactttatttatactcatattcctgatttttctttgtttaagaccttctatagcctgtgtcttgaaatactatggtgttttggtagtgccattcattgaatgatttgccgtcaactggctttcctgtcttgtatatcctttctacaaatgttcttttcatacactccatgtcacctacggcaaatggcatttccctgtcctctacacttgtcacaacaatagggaggggcacacgaaacactttcatcgcattaataaccgatttcgtatagatgtgacaaaggtgaaaagcagaacgttcgaatgccacccaataattatcaacacggtacagatgaatatgctctctattggaacgctcactgaaaagtatgtctgacagatgattctccatcaacttgccaagctctatgccgaacctgttcattgaaattgtgattaaatcaatttataatagcattagttttcggtcgcaagggggattgatttttcctgtttgttagggaaaaatttacaatcggttcatatcctcatggaataagctgaatatactccgcttctacttctatggaggcagccaacaaggtgggcagttccaccagcagcctttttgtcttcgaaccacgtgtggtcaccaatgtgcccgtatatccgtccaactgcccgccgatgatgcggattttccggtttctcatctccggtgtcacctcgtcaggggaatagaacttaggattatcactggcttctaccgccttgatgaaacgttccatatctgcgacagggacgatgataggagtgtgctgtacaccgagcttgtaacggtattgaagcttgggggtactctccacaatggcatcaagatgctccctcgtgtctttcacgaaaagcaagtcctgcatgaaaggcacttcctgatccacccgcttgccaccaactacgaccaaacgatgcaccataggagtgaaacactgcaccttcaagttctcgaacatcttgtaggcgggcaatttggcatgtctgcgtttgaggtcacgcatggcataccagtgcagtttatcctctataggtagtatttcgtccatgataataaatggatagccttacgccttagttggtgaagggatacatttccgactcctccaagtgtttattatatattgaaacacatgtagttacaacggtattatccaaaagttcggggaaattccccagcattatatatgctatcattatcttatttcggcatgacctcaatcgtactttggtagactcgaaatcatgtacattatcggtacatctctccgtaagagatgtatcatgtttagcaattggagataattaggtgatatccaatgaagtataaaatgtaataattacaatttgtcaaacaactgttcgacaaatcctttttaaggacgtattggaaactattcatttcttaacttttttggtatttatcaccgttttcccaacaattgtgtgtaactttgcatgcgaaatacatctcttacggagagatacaccgatttgtcgaacaaatccactttctaccgccaagcctttttcccaacggttttcttgtcgattcgcattttattccccccctaatccgcttatatacaaaggatagctgtacctttaatgaggctaccactacagaatgtacatcgcgctctcaggccttgaatcggtacatctctctttaagagatgtatccaacctgctatttatttgaaaataaacagtttgttaattcatacacttttatttgtcaaacaattcttcttcttttgtcgaacaaatcctgtgggaaggttcgcccaaaacgtaattttcaggattcatcctgtgtggattgcagtattttttgtaattttgcggcgtgcgaaacatctcttaaagagagatttaccactttgtccaacaaaaatccccctgaacgggaaaggttcaaggggaatctctcaacttacaaaatgtgtttgggggtacccaatcattcttatctgccaatagaccggatgaccttgctgttggctttgtccaccaccgaagaatccagtagggccaaatagatgcgggtcgtatcttccgaatcatgccctaacgcctcgctgatgacaggcacgggcacattctgactcttggcgatgctggcccacccatgccttgcgacataaaacgtgagcttgatgggacattcaaccatccggccaatcttttgcaaccgcttgttcatcacatgcgaggcattcaggtattgccgtctttccttttctcccggcaccttgatgatgggaagaaggtaaggagaatccggatttgtgtatttccggacaatttcctgcatgggctgctcccatttgatgcaaagctgttggtcggtcttgtgccgccgatagacaagcacgccgttttgcaaatctttctttttcaagaaagccaagtccacgaaagacatgccgcgaagataaaagcagagcaggaacaggttccgggcgaaagccaaggccggatataattccaaatccagattcttgatccgtccgatgatttctgaggatacgccccttttgaccgtcttctcaactcccgtatggacatggcggaacggactgcggttttccaccaatccttcctccgatgccctattatataaggtacgcagattgcgcaagtaaaaagataccgtattcgggcatttcccgttctgcttcaggtaagcctcgtattccatcatcatgacggaatccatcgcatccaaaggtacatctcccgcttcgccccggaaacggatgaaactgttgagtgaactggcatagacttcggatgtccgctctttccccatgcgtttggtctggtcgatgactttccgggcatagacaaagaaacagtcgtcatgtccttccggactgtgataggcaaggactatctgctcggaagaaagtttccctgactgttccagcttccggataatgccgttcaaccgtttctggtcttcctccatacggaaacgcaaggcttccagatagcgttcccggtccggattgcctttcacgctgcggattttgcccgcttccttgtcccattcataaaggtgcaatttataccccgtactaatcaggcgggtctgccgcccgtgtatcacttgataacataacgtgccctctttgcctgcgaccgaagaggacctgaacttgatttttattgttgccataataatcgttttttttgctgataaaatataagtgagccggggacatacggttgtcctcccgtatgccccttaactgtttttatccaagcgcctcaaatcctcactttctttacctgcggtaaaggtgcctccgtttgcatttccggacggatatgccaagtgtgcctgtctgatggcggagtcgggacgatttcatgagataccccggcatggagactttctttctgggattcttttccctttccgtcttcttccagtactggctcttgtttaggagccagttccaactgtatcttgcggtcaagagcggaaagttcggatttcagttgtttcagttcctcctccttcttccacgtcttgcccgctatctcctgcaactgcggtatctcacgctccagcacctcgttcttttcctcgtactgcttgataatcgccgggatacgctccaacgcattgaggaagttcaaggcggcggcatgggtgtccgccatcgccaaatgcccgttgttgtaggtgtacttgtagttaccctcgacatggaaacggttgtcgatgaactccaacccctcgctgagcgtccgctcgctcaccaccttgatggggaagccgtacaattcaccgatacgctggggtactccgcctgtcgtggcgttcttggctatatcctgcaaccgctttccgatggccttttcatcggtggtgtccagcccgtcaatctttatcaggttgagccggtttccgtccttgtcgatctgtgcggcagcggtgaacttctcccaatcctccgtcatggcggcgataatggcttggttgttgcgcagagcggttgtcttgctttccagcttcagttcagaatcgcgcttgcccctgttgaacgacttgcgctcaccctccagcgaggcgattttcttttcgagcttcgccttgtccagcaagtccgtgttgcccgacagtatcgccatgtattctgagaagttcatgcccgacttctcgtccatcgccccctcgtcgatggttcgtgcgcccatcgcgccggacttcaactgcgatatgaacgtctgcttgcagtgcaacaagttgaacttgtacgagtccagcgacttctccacggcatagatgatgacgtccaccttgttgtccgcgtacagcttggcaatctcgttgcctttcctgaccgcccgtccgtcacgctgggcgaggtcggacggccgccacggcgtgtcgaggtgatggatggcgaccgccctgcgctgggcattcacacccgtgccgagcatactcgtcgatccgaacagcacacgcacctgcccctcgttcatcgcctcgatgaccgccttccttgccttctcggtcttgcactcctgaatgaagcggatttcatgggcgggtatgccgtagtcctccaccagcttgcgcttgatttcggtatagacgctccatccgccgcccggctggaatgtaccgaggtcgctgaacacgaactgcgtacccctctgcgcatcgtatttatgatagtattccgctatcatcttggcgcaatggctcgccttgttgtcggggtggtcttcgtaattcgggtcaatcatgcgcatgtccaatgccatcttccgggcatagtccgtggcgatgagcatcttcgccttttcctctgtttccgacagcggcggcctgcctaagatagtcgcatcgccggacttggcgaactgcatcagctttccgataaacacctcttggtcgggcgtgggcggaatgtggtgcagtatctcgttcttcttcggacgttccacgccaatgtcctccgccgtgcggtagtcggttatctcgttgtagaacgccgccagttcgggtactttaataaagtagcggaaacgttccttctgcacgatgctgttcgttacgttgaactcaaagtcggtcgtcttcttagcgaatatcgccgcccatgcgtcgaaacagcggatgtcctgcttctccaacgccttcgggcgcaggtacttgaacagcagatataactccgtgaggctattggatatggtcgtgccggagaggaacgtggctcccaaatccctgcccgtccgttcctgtatggtgcggatggcgaacagcaggttcagcgccttctggctcccctcggagttgcccagccccgccactcggtcgtggcgcgtgttgaacgtcaggttcttgaattggtggctctcatcgacaaagaggtggtcgatgcccatctgcttgaagtccgccacgtcgtccgccctcgtcttgatggcgtgttccaccttttccaatttggcttgcaggttgaacttgcgtttctccaagccccgcagcatggcgcgtgacacgtccttgccctgactacgcaatacctcaaggttttcctccaccgtgtccagttccgcctgcaagatgcgctgctgcaactccggcgactgcgggatctttccgaactggtcgtgcgacatgatgacgcaatcccaatcgttgttcttgatgtcgttgaagaagcgcacccggttggcggcggaaaagtccttctccgaggcgtagaggatgcgggcgttggggtaagccttgcggtaggtctcggcaatctccctcacgttggctttcaacccgataatcatcggcttgtgcgccaagcccagacgcttcatctcgtaggaggcgacgcacattatcagcgtcttgccgccgccaacttcctggtcgcctatgccgccgccgttctgtttcaccatccatacgcaatccttctgcgaggggtacaagtcctttatgcccaagcctttcaggtccaagcccgggaacttctggtgcgagccgtcgtacttcgggcgcacgaagcagttgaacttgccgttgtacatatctgtcaggcgtttcttgaactccggcgactgttcttccagccattcggtgaagccgtttcggatttcgtcaatcttcgcgttggcgagctggatgccctcgctgtcgcgcaccttgatgtcgttcccgttttcgtccttgccgatgcttttcatcatgtccgggcaggtgttgtgcagcgcgtgtttcagcaggttcatgccgtcgtagttgcggtaatagccctttaccagaaactcgtctgtgattttcatcgtcttgcaggcacagttcacggaatactcgtcaaggctttccgagtaggttatccgcacgtccgtgtcgaacaggcggctcatgtaggcggcatacacgcccgtgggtatccaacgctccccgaagttgaagtccaagtcctcgaaggggatttgttcgggcacattctcgcgcaaagccgccaatgactcctgcgcctgcggcagcattgcgtgtccctcgtgttccctaatccagccctccacgtcggcgactttctgcaccacgttcccggcgatgaagcggtcggcaatctcgtagccctccgccaacgggttgtagaacacccgccctttcagggcttccagcatctccgcttgcggcaggtcgcagagggattccatgtagggcaggttcacgccgccgtacaggttgagcgaggcggacagggcttcttcgggcgattccacttcgaccaatgtttcctgcgaaaaggaaacgggacggtcgaagatgtccgccttgacaaactgcccgtcctcgccgcgctccaacgagagcatgttgcgccccgaagcgtccatcaggatgaactttgcgttgtgcttggcgttcaggttgccgtagcgcatgacgaactcatcgtagtaggtgttcaggttgcggcgcagcagggcgttttcctcgtggttctccgcttcgtggacgtagagccgctcgtaggtgttacgcaggtcgatgtacaactgtgccttctgcgcctgcatcccctccatgtcgagcggctggaaagtcgccccgtacctggtgacatccctcagcaccccgatttggaagcggacgccgcctgtgtgttcccataccagagagccgtctttcaagtgcggctccatgatgcccttgaacgggcgtggcatcatcgcttcctctttccggcgttgccgttcttcgggtgtcaaggcggcttcttcctcgcgcatttccctttccacacgctcgatttgcgctttcccttccgcctcaaaaccgttctcaacgggataaaatgggcgcacggacgatggttgctccatttccgtagcctgtctttcttcttttttcgcctccgccgccctttccgcctgtttggctgcattggcatccatcttctcccgaccgaggcggcgcagttccgcccggcgttccggcgtgagcgacatcatcatttcatagaagccgttgatgggcgggttggtctcccagtccagactgcggtagatggcatcctccgggtcatcgtcctctgtggtttcggaagcgtctttcacatcgggtgaagtggcagaaacggtttcctgtcgggacgcttgcggcacatccatcctgttgcggataatttcctccatttcctgcgcttcttccggagtcaaggacgtgatgtcggaagccgcttctgtggatttggctttcacttttccgctttcttttttcgccgcttcctcctttccgctcttcgggagggagaacaatgttggctgtacggctttcttccctttggacttaccgcttttcttccgttccggtttcagcccccgttccgccaaccgccgctcttcctgcgtgtagccgaacaggtcgtacaagtccataaccggggcttcggggcgtttgctttccacctcctgagccacggcttgcaccggttccgctttcaactgtaccgacttttcttcttttttcgcctccgtctgcataggttgtacgacaatcgtctgccgagtctcctgccttttttccttgatgccattatagcgttccaagtccagccgtgccgacaagtccgccgacagcatttggtacaaatccgttgcgatgccctccacaccaccgctgtgcgtataaaccatagcgggcttaccgtaagggtcggtgtcccttttcgcgtcggtatggatgatgcgttccgggtggtcgaggaaatacccgttggaaacaatgttcgtgtggttgctctttaccacatcgcccaacctcttgtcttcctcggaaagttcctccttgccttcattcttttgcaggattatcaggtcacaccccacctccgtgttggcatcttccgtgaacaggttgttcggcaggcggatggcggacaccaagtccgctttccttgtcatcatgtagcgtgtgccgccgttgctttccgtattcaataccccctgcgaggtgatgaacgccacgatgccgccgtcacgcaccgcgtccagccctttcaggaagaaataggtatgcaccttccttgccgctatcttcttgaacaccgagccgttggcatattccgggtcgaacaccgcgatgtccccgaaagggatgttggatatggcaaggtcaaaacggttcaggaacggcttttctatcttctcgaagccctccgtgcgtatcttctgctgcgggtacaggtgtcccagcatcttgcccgtcagcaggtctttctcgaaggccatcacctccgcctgcgggttgtccgacagcaccgagccgatgaacgcgcccatgcccgctgacggctccagcacgaggttggggcgcaccttcttgtcgtgcagcacgtccgcgatggtgtcggttattgctttcggggtgtagaacgccgtcagcaccgaggctttaagcgagtccacgtagcgtttgtactccgtttcatccttgctgttctctctaatgattcggtgcagttccaccgtaggcgcgaacagttcgaggtcggacttcgcccaacgcgcggcgtccgccagttcccttgccgggttcaggatgcacttcaggcccccgaagccgcagtaacgctctaatagcgcacgttccctctcggtgggtgtgcgccgctcccggtccagcgtgaacgccgtgcgtaccgcctcgatgttgtcgcgcatcttctgtttcctattgaacgccataggactccagataaagcatgacggttcccaccagctccgtgtagagcaggtcgtgtccgggcgacagggcgaaggtgtcgtccgacgtgtcgtaaccggcgaacaggtttgtcaagtagggataaagctcgttgcagaacgcctcgcggccggattccgccacctcgtcggcgaactcgttttccacgacctcgcgcagcagggcgtagggcgagaagtgcagcccgtgcagcaggacgcgcatggcttcctcgtgggcatactcgaccgtacttcctgccgacctttctttttcaaaggtggtggcggcagcttcctccctctctgcaataaggtacgtgtcggaaactttgtcgggatggtattttctcaggtagtccagcaggtacagcccgtagtaggacagttccgctgggacggttttcttgttctgtttcattttctgatggatttagtggtgaaaaatcagattgtggaatggataggaaagaagaaaaaaggcacccggtatccctccgagtgccgccactaaatccatgtgaataacgagtatcaacgaattgaaacagattatgacatgaatcagtggcaaaagtaatgcaaatcgaggggagaacaaaataagctcgcttattttttattccgagatgcagcttactttattaaaaggtacgtattattttcttcctcctttcctgttagtgaatttttttgtgcctttggcttcgggaaacacgaattttgtattgaaatccgcatcgaatgtgaccattgcgctgaacggcttgccctgcctgctcttgaagccgttgaggacacccgtgctgccttttgccagcagttcgttcatttccgcgtcggtgagcgtcctgcccgccatctggcggaacacgggcagggcgcagtccgggttgtcgcagcgcaccaccttgccgtagaactgcatcgtacccttgccgcacttggggcaggcacagtccgatgccttgtgcccgaacagcttgtccgaggcaagcagttccgtggtgattttccgggtatagctttcaatgtcgcggatgaatgcctcgtgcggcatcctgcctttttctatctccgccagttccgcctcccagcgtcccgtcatctccacgtcggcgatgtccatgcccctgacgatggaatacagggcaagccctttctccgtcggcacgagcgacttcttcacgcgcaccatgtattcccttttgagcagggtctcgatgatggcggcacgggtggcgggcgtgccgatgccgcagtccttcaacgcctgccgcgcttcctcgtcctccaagccctcgcgcccggcggtctccatcgccgccagcagggtgctttcggtatgcaacggcttcgggcgtgtcatgcccgaactcatcgaacagccgctcattgccaatatatcaccttctttccagtcgggcaaaacggtgtctatgttgtcctcgccatagaccgaccgccagcccgccttgcgcacgatgcagccttttgtctcgaacgctatgccctcacactccgcccggacggtggtcgtgtccttgacgcactccggggagaacgcttccaccatgcgccccacaatcatgtcgtagatggtctgctcgtccttgtagagcgccaatggacggttgggtgtcaccaacagggcatggtggtcggtcactttcgaggcgtccacgctgcggcggttcagtccgtccaaggctccaatcttctccgcaaaggaagaatgggttgccagacggtcgaacagcatgggcacttcgtcaaacacgtcctccgggatgtagcggcttgatgttctcggataggtgacgagcttcgcctcgtagagcttctgcacgagggcgagcgtctgttccgccgtgaagccgtgcctcgtgttcgccttcttttgtagcgtggtcaggtcgtacaggagcggagggttctctatcttttccctcttttcgactttggtaacggttgctgccatctgttcctttaccttattatatagtatggcggcttcctccttgtccttccatttctccaccgaggcgaacttcacgacctcatccacgctcaccgacggcgtggtgaaatggagctggtataccggttcgggctggaaacgcttgttctcccaaaaacgttggcagaccatcgtcagcgtgggtgtctgcacccgtcccacggaatacgtgccgcgcccggcggccaccgacaacgcctgtgtgccgttgatgcctaccagccagtcggcttcgctgcgggctttggcggcttgatagaggttgtcgtattcgcggccgtccttcagtttctttaatcccttgcggatggcggcatctgtcagcgagcttatccacagcctttggaacggcagggtgcagccgatataggaatacaaatacctgaaaatcagttcgccttcacgggcgcagtcggtcgccacgatgatgccatcgctttcgttccacagcttggttatcaccttgatttgcttcaccgccgccgcgtccgccttgtagcccttgtccgtttttacctgtcggggtataagctcgaagtttttaggaatgacaggcaggctgtcgcgccggaagcccttgatgccgtagccgtctggcagggcaagctgcaccagatgccccagcgcccatgtcacgtggtagccgttcccggtgaaatacccttcttcccttttcatcgcgccgacaatccgtgctatctcacgggcgacgctcggtttttctgccaatatggtaatcatgtctttctctgtttttttattcgttgatacttttgtctttaatggggatgaaacggggcacggcattgtttgtgggatatgcgcacaaggcggtgcatgttccccgtttcagcccgtcaatacttatcggatggatttagtggcggcaatcaggaagatactttcatgcctttggatttcttggcctgctgcttctgctgcgcatcattcttcggcgtggtctgaccctgctgcaacggctctttcacgtgtttggtcgcttcgttggtcttcccttcgttgttcacggcgagctgtgtccggctctcgttggacggtgcgacggtctgcgcgaggtcggggttctgcgagtaggtcagcggtcggcctttctcgaagttgaacttcaggtacttcgtgcagggctggccttggtcgtccttcgcattggcgagcaccaccgtcttgcccgccacgtagtcggctatctgctggtcggtaaacacatcgtctttccatttcttgatggggcggatgctcccgtcctcgtttgtccacgagcggttacggcgttgctggttattcccatcttcttcaccttgtgactgttggggcgaattggaattgtcctgcgccttaccttggccgtttccctgacgctgggattgctgctgcctcggttgtcccggcacgaactccacatcgcgcttgtcggcgttcacctgcaacaaggcttggaacttgcgcccgttggagagcatcacttccttgggcaaaggcaatcccgcacgtaggatgtcctgctcttcccttgacaggttggtctgtccgattttgttagggatgcgcaccttgtcggcagggatgtccacgatttcattcgtcaggcggtcgatgctgatgtagtggggcttgatttcacctgtcttctcgttggcgaagttgacgggcttgccgaggttgcccgtgcgtttcaacgtcttcttgtcctcttcggtgaaggtgtagcccctgtgggggatgtcaaggcgtggttcattgcggataaaatggggtgtcagcttcagatagccgtcctccatcttctggaaagacaatcgggcctgcaattcgtaactctcatagccgaaggtcggctttaccgtcactaatcccgtcttgccgtagttcatcagggcttttaggtccttttccgagagtttctccttgtcaatgccgcacttgcgcagttcctcccagtttacttggtcgtccgctatcagattaggcttctcctgtgtttcagctacctgtggctgctgaacatccttctcttgtttcagttcttctttcttttccatttcttctgtctttttaatgggttcgttgttatttttttcttgtttgacattctctgtttctgcttgttgctggtacttggcggtgtccaccttgtgcgaggcaagtatctccgcgtttgccacggggtctttcaggaagtccttgatgacgggaagcagcgtgtccaccgcatccgccgccacccgatagaagccgaagcgcgtcggctccttgcactggcggtagaagttcttgaagaaattgtccaccatgtccccgtggcggtcgaagcgcaggaagtcctgcgagtgttccggcttcgcgggcttcgtattggggtagcccttgccgtccagcccggcgaccacgctgatctcgcccgttttctcgtcgcggacgaccagcacgtcctcttgctttttctttttctgttccatttttttcgatgttttttaatgggttatcaaaatcacagcttgcgccattcgtctatttccttctcatatatttccaagtggcggcggacgatgttttccgtcaatcctgaaacgctcattttccgctcaccgaacaaccggactatccggtccagcctgtcacgggtctccttgctgaggaataccggcttgcggtcttcaatggcaggcacgggcaggtaaatccgcctgtaatccgccaaggcttccttgcaggtggccatactcggtttctgttctctggtttcagccgtcatggccatgttttctttttccgttgccatcatttttacttttattttttaggtgaatacttcttgtggcccggtcttttgccggatttgttctttggggcttccatgccgggttgctctttcatgcggagcaccttggtaccgccttgcagcacttcctccatattttggctgatgaactccagcacgtccgattccttgtaataggtcttgtgaccaatccgttggtaacggagcctgtacttgcttcggaagcgttgcagcgaccgtttgcttgtcctcagcatctcgcacaggtcctggttgtcgtacaaccgttccccgtccaggtacttcactccggcggcatccttgttcaccagcaccgagatgatccggtcctggcggtcgaaacgttccatgatgcgtcccatccattcctcgaaggtgtcccgcccgaccgtttccgccgtcttcgggatattctccttcttgaagattcttgcggcttgcccgccactgcttcccgccgcttccacggccgggttctgtttcactttctctgtgtccatatcgttccttgttgatgattacgctgcaaaaatcggtattgtgcaagaggcgttttccatagtcgttaccgagtcggcaatgatttttttgaaaagtcccgtccggcaggtctgaaaaagcttttatgccgctgtttccatccctcaaggtacataaggtgtcttgccttaccatatattatatataaggtgtggggcagggactggaacaggaatgatggggagatagatgtacccgaagaacgccaacggctgccacgacaacgccaaatgctgccacgcgcctgacaagcggtggactctgcccgtaattccgtttactttgcggcataatcacaattaaacggtaatcttatggaaaatgtaatcgtaatcgagcaaaagacttttgaggaattgatggcgcgtttcaaccggctggccggaatggtggacaggttctgccgcaaggcggaggagaaacgcctcagtgaatggctggacagcacggaggtgtgccagatcctgcaaatcagcccgcgcaccttgcagacgctgcgcgacaacggcacgctggcttactcacagattgtgcgcaagatgttctaccgggcggaggacgtgcggcgcatcgtgccgctggtggaggaacgccgcaccctggcggccttgaaaggaaaaactatttgaggaaggttaaatgagtatcacttaaatcagactgacaatgaacgaattgatgacaagggaaagcggacagatggccgcgctgttcagaatgctggagcacgcattggaccacattgaattattggccgaaaactaccgccccgtattgggcggggaacgctacctgacagaccgggaagtggccaaattgttgaagacctgccgccggacattgcaggaataccgggatgcggggcgcatgtcttatatccagctgggagggaaaatcctgtaccgggagtcggatatcgaacggctgctgatggagggttatcgggaggcattccgtatcggaacctgagaaggacatgggaaaaatgtaggtggcggtagaagtcgtgtacgcattgaaaagtggaccaccctttccggtatttgcaaaaaacacttgcaaatgacccggccacctgtaggaatgtacgaaagcggcgcatcacgggagataatcctctcatgatgcgccgctttattgtgcgtgagttgataatacggtcaattccgcaccatttgccaatgcggactgaccggaaagatgaacaggcgggcggtattccgtccaccgtggcaagtgaattttccgatgacccgttctcgcagacgttttgccccgcaggtatgaaggcggaaggcaagggcaatgaccaacgggaggccgtacagcacgtccatcccgtacccgtccgcttggcggacacgacgttccgcttcgccgggattcaggatgccgctcttgtacacggcctttatcgccgcccggagcgtgagggcaaccacgccgaacagttccatcagttccggttcattcatccagatggctgttgcggaaacatccggcacgtgaagtgtgccgtgttcgtccaaagtgataatgtaacgttccatgattcctgacttttttgttattcatccattggcatttcgttccggctgttgcgccgttccatcagacggtccatgtccttcgatatcttgcagtcggtaatctgcgcataaatctgggtgctgttgatgtcggcatggcccatcatcttcgccgcgctttctatggaaatgccctcggagaccaaaagggtaccgaaggtgtgccttgcggcgtgatgggaaaggttcttctggatgcccagcatgacacccagcccgtgaatgtcgtaccaaaggatgtcccgcttgggcagggggaacacgggacgggtgtcgtccgtggtattgtacagttccagaatctgccgagcggccgggtgcagggggacgaaggtctccacctcggtcttttccctcggcttgcggatatagagcctgccctcagaagttttgccgatgtgtcgggggtacaggttatacacgtccgcgtacgccagaccggtcagcgaggagaagatgaacatgcggcgggccagctccaccttgggatccggcatcggcgtggccataaggcgtttcagctcgctgcggctgatgtggcgcatcttgggcgggtccttcttctcataatgcacgtcctccaaggggttgcaccggagcacgccctcatccaccgcaatatagataaggcggttcagccagcacaggcagtggttcacatgcccggaggcataacccagttcctttttcaggaacagtttgaacgaatggccgaactcctccgtgatgtcggaaaaggcgatgtcctccaggccacgggactggaggaactgttgcaggttgagctgcgtggtcttcgactgccggaacgtggaagtcgaatggatttgttcggcacgcagcctgagccgttcccgctccgcttcgccgcctttgagaagggtctggggaatggtcgccacacctgtcacggcgtttttcagcagttcggcgctgactgcgccctgttctttcaggaggcggtcataagcccgttcgagattcaggcggaattctgcgaggcggttgttctcgcggggctggcggatggttcccgtctggctgttccaatcctccggacggcagaagatgccggtcgtgatgaggatgcttttgccgtcgatggacacacggcaaaggacggcggtcgtgccgtcggacttgattcttttcctattgatatagggcaatatcttgaaagtgctacgcatgatggttcattttagctgatgttctacatttatttttttccaatctcgtttttacaaccctttctcataaaaccagttcaaggtctttggtcgcctcaatgaagcggtccatgtcctcgaatagctttttcggggtgactcgggcatagatctgggtcgtctttatattgttatgtcccagcatcttgctgatggtctcgatgggcacgccctcttcgagcgtgacaagcgaggcaaacgagtgccttcccatatgatagacgagttcggtcgtcagtccggccagcacgcgcaggattttcatgttcgcccgaagcgtactgtacagctggttagggaacagggtctcccgcaaatcgtcccggtatttctctatcagggcaatggcctcgggtagcagtttgacgcgcgccgtcagttcgttctttttccgtcggtatttcaaccacaggctgccttcatcgtcggtgaagaggttctcgcgggtaatggatatggtgtccgcataggcggttccggcataacaggcaaacaggaacaggtccctcgtaaggacgagggagcggcgcttttccgggatttccaagtcacgcagcttctcgaagtcctcgcggctcaacgccttcggggtggtctccttctgcttgggtatcttgaaatgcaggaaatggtaccgctcggagaacccttccttgtacgctatccggcagatccgtttcagcagggccagatgatgccgtgaggtctggttggaatacccgcattttacttcgatataggactggtattcccgaatgaactgttcgttcaacgcaccgaaggcgatgtccttcaccttgtattttttcctgacaaactcgccgagcgttttccgcgcataatggtaggtgctcatggaggacgcgcacacatcgatgccgatgcgctccctcgtttcctcgatgtgccggtcgaacagccggagcagggtcatctgggtttccatgcttccctggaaaaggttcctcacgtccgcagcgccgaaatcgcgtttccgttcctgcaattcattgaatgccgcatggatggccagcagcagtttctcgattttcgcattggtctccaccgcctcgcggctctttccttccagacggttttcacgcacgttccacagcttgggcgtgcacgagagcttggtgctgaactgcgccaccgtccggttcaatgtgatgcgtcccatgatgggagctttgcccgacttgtcgggttcggtcttcttcaaaaacagcaagaccttgaatttctcaattttcatacgcctacatttttttgagtgcaaagttattatgaatgtaagcgttcatcgctacgcaaaatactgagtatcatagaaaaacaacccgtcggagaacttttttcaatcatccggttaacacggcaggtttccgaaacaacctgttaacggttaagaaacggaaccgattcggcattccgtctgaatccgtttcagaaaggtgtgccagataatgaaatgtagctcatttctaacagattatgtttctaacgcgctgttctatttgatgttgctatgctaatgagttcccacaaggcgaggcacaatttcgggacacatatcacgctctcgttgggtgtgcctatcgaaactgtcagccgcatgatgggacacaagagcatttccaccacgcagatttacgccaaagtgaccgaccgcaaggtggacgaggacatgaaacggctgaaagaacagaccaaaggccggaaaataaatctctacgaggaggacgaaccggaaacggcagatattataacggtaaacggttgaacagtataacaaaaattgataaatttgtatgactatgacgacaagagaacctatcagcattgaaaacgggcgggtggaaatccacgcgccggagaaccgtgtatggctcacgcgccaccagattgccgacctgttcggagtcttcgttcctgccgtggggagcaacatccgctccatactcaaaagcggcatactctgtgaggagagggtttaccgccgggagcgcaaccgtgacggcggtattgtcgagctgtattcgctcgaaatgatcgccgcgctggctttccgcttaaaatccgggaatgccgaagccttccgacggtggcttgtccgaagggccacgacgaccgctgtcgtctggcagctccccggcatgaacacgatattgaactgaaaaagaagaacggccaacgttttggccgttcttcttttatacccattcctgtcccccgatacatttcttccgggaatcttccaggaatttctgtatctcggattccatgtatagtaccttgccctgaatcaaataatagggaatgatccgcgccgtgcggtattcctgcaatgtacgcctgctgattttcagcagccgggacaattcctcgtcggtgacgaaccgctctcccttgagtgtccggcctccggaggattccagtttatccagtgccttgccggccttttccaagcgccggaagagatccgccacacgcggatcgtgcttgtcgatgaaataatggctcataacgcggcggtattaggatagtgcgacgattgcagcagtttcccgacatcttccggtttgtagaagattttgtgacggatgcggctgaaaggcagcaaccctttctcccggtaggtttgcagggtacgtttcgatatacccagcacgtcacagacatcctggttgtccagccattttttcaaactcacgtcctcttgcctgcggcataacgcctcggcttttctttcaatggcttccacgtgccctgccagcgcgtcgaaagccttcacgtccatacttattatttccatgttctgtttcattttttgtttcccggatgcccaaaagtacacaaatgaacagtatcttgttatcagccagtggtatatggacgtatccgtcttaaaagtggcagcgagtggcgccacgtccggcggaaacgatcctccgccgatacgggatcggcacgttccgatacgccaatcgcccgtgaaaggaaatgttcgcgggcgatttatcattccatgcagggtgagccgtgaaccgactttcgcgagcgttcacggcatatcgttttctccccgtttctcccccataaccttttcctctcttttttttcatgccgcggagcgcggtatggaaatctgttgtcagtagcaaaggtagttacggggctcacgctgctgcaagatcgggccgcggggcggtttgccgcaaaatcttcctctttccctgcgggcgagcgtattttccgacaaaatcttgcagcagctatccccgacaccttttgatgctaccgaaacagattccatccataccggctccgctacggcataaaaaaaaagtcaaaggttatgagaaacgaagagaaaaataaatggaaacagaaatcctccaaccttccacttggcataaaggcaaaggtcgggttggcggtaaaggtcggggcggtgactttgggcttccacgtgtggggtatcgactttatttgggtcgttttgggcttcacgttctgttatgacatcctgcggggcattttctcctgccttgtttctctcgtggctctaaccggctttttctatttcctattcactcacatcttctaaatttttacaggtatgacaaagtacatttcattattcggagcgactaccacggacacgcaggtgcaggtagtcaaggaaaaccaggtaatcatcggtatcggtgcgggtgcgagcagaaagcgttacgtcgtttacaaggtggaacacaccgcccgtggctacgtgtaccacatggtcgataccgaaacaaaggaaatcagccaaacggacattttgcgacccctctcgcaaacattcggtatcggcaggtactacgacgacgtgaaccccgagttcatggacgctttcgaggtggctttgctcgtgaggcaggcggaagagcaagccacggcgcaggccatcgccgccgccaaagagaaagccgagcatgaccgcatagcggaaataggagcgcagaggttacgccgcatcatgcccgaaggggtgcagggcgtaatcatcgccgaactcaacgaaacggaatacactgacccctcttacgagtgttcgaccacccgaagcgtgcgtaccgtcattctcggcttttcggccacctctcgcaacggcttcggggagttgagaaaggcggcggccaatttcccgcaaacggcgcacctctccgaatacgaccccaagaacgaacaccgctatcccgttttcacgctcggcaaaagtccgaaatacgggtggagtgtctgcaaactgacccactacacccgtgaagggtacatcgacaggctggcatatatcgcaggaaacgaggagaatatatgtctgcccgagccgaaagacgaaaaacgggcggaacgcactgaaacgagcgtgcaaggcgggtttatcatcgtggactattccgagaaggcgatagccgtattcggggacaccaagcccgtcaaggacgcccttcacgcactcgggggacgcttcaacgcacggctgacgcatgacgggcagaagaaagcgggatggattttccaaaagaccaaagaggacgaggtgcgacggcttctcggaaaggacgaataaatgttgaacacggggtggctcgccgccccacaataccaaaaaatcatggcacaaggaacagattatttcaaactgacgatacagaactatctcgacgcacgggcacgggaggacgaacttttcgcaccccgatacgccaacccgaaaaagaacattgacgattgctgcactttcatcatcaaccaagtacggcagagcggttgcaacgggtttgccgacgaggaaatatactctatggcactccactattacgacgaggaggacatcgacatcggcaaacccgtcagttgcaaggtagtggtcaatcacaccgtcgaactgaccgaggaggaaaaagccgaggcacggcggaacgccatacggaaggccgagagcgaagcctacgccaagttggcgaaagccaagtccaaacccaagaaaatcgaagataacaaactaatgcccagtctattttagttatgaaaccgagaacaaaattccaacagaacgtcgtggcggcaagcaaacacctgccgccgcttacccccgcacaaatcgaatgggggtacaagaactgcatcgagcatatcggacgccgcacgccgaaaggacttatcacctgcaccgagtgcggccacacgtggcagagcgaaaacggagaactcacggacaatctgttagggtgcgagtgtccgcactgccacaccacgctgaaagtggaaaccaccctgcgccgcaagttcaacgattacgagtatttgtgcatcgtaacccgctgcaagggttttcaagtcctgcgcttcgtctatatcgagtgttgggcgaaagtgggacagacgcccgtttacacccatatcgaagccgtacagcggtggattgcccccgacggacgctccgcaaccttcgcacggctgcgcccgatgggcttcttcgttcacgggtggagttggtcgagcgcattggaactgcgggcggagaacgacgggaaatacaacatcacgcccacacgcatctatccccggcaacggcttatccccgaactgcgccgaagcggttacggcaaacaactccccgatgtaacccctttcgaccttatccacctgctgctctcggagaacaaggccgaaacgctgcttaaagcgggacaaacggcactcgtgcgatttttcgcccgttcctcccgcaatatcgcagactattggccggccatccgtatcgccatccgtaacgggtacgctatcgggaaaccgacggaatggtgcgactacatcgacctgctgcgatttttcgggaaagacctgcataacgcccatttcgtgtgtcccgcagacctgcccgcagcgcatgacctctacatggctaaaaaacggcggcacatgcaaatggaacggcggcaggaggaacggcgcaaggcgttggaacaggaagcctcgtttgtcaaagccaaaggacggtttttcggagtggagttttccgacggggaaatccgcatcaaggtattggacagcgttgaagccatacggcaggagggcgaggccatgcaccactgcgtgtttaccaacgaatactatctgaaagccgactcgctcatactctcggctacaatcgacggcaaacgtatcgaaacgatagaggtgtccctaaaacgcatggaggtcgtgcagagccgtggcgtgtgtaacaagaataccccataccacgggcaaatactgaaactgatgaaggggaacatgtcccttatacggaaacgaatgacagcataaaaatcggggcggcgaaagccgcccgcaaaaacaaaatagaatgaaccaaatagcatataaattcgtgtcgtgggacgttcccgcactcgaaagccttgcaggctcaaaagcgtacatattacgcaaacggctcaatgacgggggaacgctcacccgtgaggagaaagactggattacccgtgaggtaaaccataacacctatttcaaggactccattccgcttttagggtatcgtttcaactttgtcgatgtactgaaaacattcgtggtaaagcagtacgggcattacacggaatacaagggcgtggacaagacgagcatacgctccatgttgtacggcagagtggaaaggattgtcgaattataaaatcggggcggcgaaagccgccctacaaaaaaaatataacaatgaaaatcatctataaaagctacatggcacgcccgctcaaacccttcggggagtgggattgggaagttcgggaagcagtcaagacggcccttgcgctcgtcgaggggaaaaacgggttcaaaacccattccgagatatggcgaaggtgcaacctcgtcattaccgtgggacacaacatctacaccacgagtatcgagatacgaccacccgagcaggacgtgatacgccgcaggagcaactggcataacggctacgcctactactgcaacggcgtgttctgggcgaacatgagcagggttagagtggaacttgtctgattaaaaaatttcggggcggcaaaagccgcccgtaaaaagcgagaatatgaaaacgaatgaagtaaacaaggaaatctcctatgaaacgctgctcgtaaccttcggcgagggtatcgggcggctcaacaccatgttcgacgacccgcaggtgtggggcgttgccacgctgaagcagtggatcgacgggtatgaaactacgcgcttcaccgaaatcgacgaccgaacggcggttatcacatccgaatacaacatggacagcgtgaaggaatggctgcaaaagaacacaccgattatcaacctggaaaaacgataaaatcatgcgcaagtacaaattattcatcggctaccggctgctgggagagttttccggtatatgggaagccaaaaatttcgccgctgaaagcggcatgagcggaattttctcgctcgtgggagaaaattaccgggacagttggtacgaacccaaaaaacaggacaagaatggaaacaaagattaaagacatcacgggagcggaaataaccgttaccgacttaaaagaggcggtacgccaatgccgggagtgcctcgcaagtccttacctgatgccctcggggcataccgtgggggaaaaccatgcctacatgttgcggcaactgctcgccctgcaaaggcggaaacgggaacacggcaggcaacggccgtgaaaatacgacgcgaaaaaaatcggacgataacaaccgtccgatttttttgtttcccgtcaatcgaccgccgtatggtcgcccagcttcccgtgcagttcacgcccgatatgtccggcaatgccacggggagaaatttcagagattgaaccccacccgccatgcgtgtatatgcacgtcttgagcggttcggtacgggaaaggtagaacagatagccgttgcggagcaggatgcccacgaacaccgagccgacctcgatgtcggcgatctcgtcaaaacgtatcttcccgtcattgtataatactgccgtgccatccgcatcgggaatgacgaacagatcgtcttccataacaatcccgtgcaactcgattagcgaccccaggcattcactcgccgatacccggtcgtaatcaccctttacctcatttgtcgatttcgtttccatatcgcttttctttaggttcagacaaataccatacgaaaaaggcgtgagaatacgttaaataccggcattgaggtacagccaagcacccatccactcgatagataatttctccccacgccgctatcgcatacgcttgacgcatatagacacgacgataaagaagagaactacccattattttgcgagcggattaaaatttggctgttttcaatgccccaccataatgtgttccttccgtatgtaaatcgcccggcggcacgccgccggaggattcgattgcaaatataacgatttcatccgggtatcggcgacaacacgtgcgatttttaacaaccttcctgccaaagaactacccgccgtcctacaatttcggcccccgggcgggtttgcggggcgcgaccttcggctgcgccttcttctccctgggcggttcgacgatccgcagtttgagtttctccgtcttacggtcgtaacgcacctcgcagcaatcaatctcacccgcaaccgacgtccacacgttgttcacacgcaccgcgccgcccgagtagagggtcttgtattgttcgtattcgagcggctgccgcaatttcgcgtccacctgacggtggaacgaatagatattacgtcccttcgctatctcgtcgggaacgtaaacccgcaactctggatgggcggcctcggcatagaggcacagatccgccgtgcgaagctccctcggaacccactggatcatcctcgggtcgccccgcacggccgtatcggccacgagcggcgtgatggccgtctggggaatgtcatacagcacccccgcatccttgcgaacggcctccaacgccacctcctccgttacaagccggcggttcaggtgcaggacactcatcaaccggtgtatcttctgcgggtcgtcctgctcgcggaacacctgcaagaccagggcggggtcgctcaacgcgctgataaccgagaaatcggttttgtccttcccgtaggtacgctcgaaagcctcccggctcatctccggcgtccgggcttcgcgggggacgcctttcaggttttgcgggttctcccgcaccaggctcatgtatagatccgggcttttcatgctctcgggcaggtgggcgatggcatagggactgcgccgtatggcctccatgcacaactccggcgttttccacttctcggggacatattgcaggtagctcccgtcgtgcccgacggcccggcggcacatctcctcgttcttggcgtggtcgggaaggttgtagaacagctccggctccagggcgaaaatttcccgggccactttcggcgtgacgtgtgccgggttcatgtgctgcaaaaaatcgaaggtcttctcgtaattcgtgcaatagaaccccaacgccttcatgtgtatatcctcgaaagggatatagcggaggacacgcaggtcgtcggcacgggccaacgcccggttgcagacctccggcgtgagctgttcggggttgaaaaagcggatggccaggggatcgcgctccagcgctatctcgcacagacggtcggttttcagatgcttcggaacgtactccagtgccaggtagttcgaggacacggcagcctcgcagacccgttccgtgcgtaattcctccggcacttcatggagcaggatgccgtccccactgacggcacgcaggcagactgcctccgtgcgcagttccaccggcacgagcgaaaggcaggacgcgtccatccccacgccgtgaagggccagctccccggtcatgacctccggggcaatggaggcgaaaatctcgaacttgtccacgaacgacatcccgaattttttcagcccttccaggcatatatcgggatacggaatgtaagggagtatcttgtaatcggcactgtccaccgctttcaacgccgcacggcatatttgcggcgtcctcaattccccgggaacggcctccagcaccaggccgttgcgcttcacggccgccatgcacagttcgggggtcttcaacccctccggaacgtaatacagcgcgtagctgttgctatcgacggcggcacggcacattttcggtgtcttcagacggtcagggacgaatttcagtgtttcgccccggtagccggccgcggcaagacaaagttccggcgttttcatcgcttcgggaacgaactcgatgttgaaagccgatttcttgatggcgaaacggcagacctccgccgttttccgatcctcgggcagcgtctcgaaaaggttctcacgccacgggttctcgtacacccccgtatcgagataggctatatctattctctcttgctctgtcatggttttcagtatttatggaaagcgcccgggtgacgggcgcttctcttggttagacatattccgttatcgttccgtttcctccgtcccgttctcgctctggaacgtgaaggaggtcttcacgacctgacccgtgttgtcctcgacatagacgtcgatggtctgctggtcatcgctgcgcgatgtgtaatagaggcggaacacctcacggtcgagcggatagcggtcgttgggcaggaacaccgtaccgtcgtccatcctcaactcaccgcgcccgtcgggctggaaatagcggatcgtgtaacgtgcgccgtcatatctcccctcccgcacgagcgtgcagcggatttcagcggtttcaccaacggagattcgcttctgaacgggcatcgtttccagagagaacgtgtacgcctgctgtatatccagcccgttgtcgcaggatgcgcataaaagacccagggcggcgatccagaccgccagggccaatatctttttcatctttttcatgtcgcttgcaagtttaatggattatgaatttcacgcccaggccgaactgcgcgtggaaatgtcccgttgtagtgccccataggatacgctcacgccccgtcagcgagaggataatcctgtcggtcaggtacgcatcgacctccagcgtgacggccccgccatagaggaaacggtcgcggtggcggagcgtagagccgtcatagagccgcctttcgccccggttcacactctcgtaaccggccagcgccgagccgccgaggtagaagaaaaaagtcctggacgggtcggcgaggaacttgtaatagtaacctccctcggccgtgaactgcgccaccgggatacgttccgacttgtaggggtaataacggttcaggaactccgcgccgaacacccacttgtcggcattcttcgcgtagcggctcatggccagcccgaaccagtagcccgtttcgctgcggctgtcccgggtatagaagccgtcggccatgcctccccgtatttccagcccgcgcatggcgggcagggcacgctgggcgtgcgccccgtccgaaaggaggaggcataaccccagcgtgagaatgaatatcgcccgtttcatatcactttacctttaactcgttgataacacgtgcgcgcaccaggtcggcattctccaccgtgaaagtctggtgtcgcccgccctgctgctcgtgcagttccacgaccagctgcttgtcgtcggccagcgtgaacttcgggagcgtgaagaccatgcgctcggtacgcttgccgccgatgacctgcacgttgttgtacgcacgcacgggccatacgacctgctcctggatggccgtgcgtttggccaccttcttgtccgtaatcttgaacgtcaggtagtccacgttgaaaggcacgttggaggagtttttcagttggaggtggaaataaagcaggtcgttatgcacgtagatacctttgaggaggtattgtaccccgaaacgcttgcaaccgatatgcttgatctcgcggcggtcattcttgtaaatggactgcatgatcagtttgaccagcagcggagattcgcatcccaactcctgcaaatagatgtccagcgcgttattggggcggtttaccgcctccccgtcatgcaggaagtccgccatctcgaccgacagtttcaccggctcgtcggcatacttgacattgaagctgtaataggccccgtcctcggtaatgaccgaaaggttgctctcgcgcgagaaatcacgcagggccgcctttacacgcagcacgttttccgtgccatcggctttcgccgccagaagatccgaagaccccagatcgacgtaacggatggccgaggggaaaatcacatgcacggtcttgctgaacgtcacctccagcgcgtagggcgggataacccggttgaaagtcagcggacgggtaagaccgtcgtacaaatcgcccgtggagggcttttcctgcgcgtgggcagcgaacatgcacccgataaaagcgagtgccagaagaatctttttcatactcgataattttttgattgttgataaaaatggattttttcagtggtgtacggaagtacgtcgtttgtacccttattgaaggggcgggagcagcaggacgctgtaaccggccttgagcgtgaccttgaccgagcgcatcttcttgctcacgtattgcgacacgccctggatggcgctgcgccccaggtcggagagcagttgcgaaccggcatcgtccgtgatcgtgatactgctgcccatgcccgcgcccatattggcggcgatctccttcacggcattgagttcttccgaccccggcacgggaataccctcgttgccgttcgtgtcatagaccgacagatcgaccggaacgaccgccccgccgtgctggacagcgctgaccttgaccgtcagccgttcgccgttgatcctcgccgcccccgttacgggcgtacccgaggggatgagcagatctcccgccatcatcggttccagcagccggaaagtaacctccccgccatcggtgagcgtcacggtttgctgcacggcggcgcggatactgttgcgctcgggctcgcgaaggtcgctccccaccgtgttgaaaccccagttccggggcttgacgaactcacgggcgaagaccgaatcgggcagcggggcggcgagcagcgacacgatgttacggcgcacctggcgcacgggctgcacggaagccttgccggaaacggaggctttctgacgcggggcttcaggggcctgaccgccattcatgtagcgggcggcgatctcgtaggacttctccagcagcgccacctgctcctcctgggccgttttctgcgcctgctgttcttccaggcggcgttccagttcctcgatgcgggcctgcatctcgcgctcttcccccgtttcaccggcggtgtcctcgtagaaactgcctaactggcggttgatgtcggcataggcggcacgggaagtccggaaagctcccgacgaaccgccggcagagccggaagacttatccggcacggcagcgggcatgacgggctcttcctcctcgtcctccatcccgaacgcgaaatcctgcaaggagcgcatcttttcccgctccctgcgccgcatctcctcctgcacgtaggcatcacgcttgtccgagaggataccctccgattccggggtcggcagctccgtgttgaaacccgccgaaggctcctcccgttctttttcgccgggggagaagatcagccacatgcacccggcaaaggccaggaaaaagagcgggaagaccaccatcttcttccgcatctgtatctgccggggcgtgagttcctttttccccgcctccggctgtttattctgtttttcgttcgtcgtcataattgaaatcttttagatgttttacactgtcggcctcctgccgttgtcttaattccagttccagccgctcgatatgccgtatctgcatccgttccccggctcccttgccgaagcggtagatggaagacacggtaaagtagagcgacaagacggaaaagaacaagagcagcgtgaggatcacgataatccgcttatcgggcgagagtgccccgcaagcgcggcgcaggtggtcttcgacccactccccgaaagcctttattctcttctttgccatagccttatctttttaatgtacgtaaatcgcggttctccagaatctcgaatttctccatgatgaaaccctgcgggttattgtccgaacgccccgagttgatcagctcgcagcgcgtgaccagcgaacgctcggtgatgttgctctcgcggacaatcatttgccgggcataggtcatggcccggtagggataggcgttgaagtcgcacaccacggagtccacctcgatacgctggctgatgttccccgacaccacacggttgtagtaacctttctcctgcatgtcctggtaataggcgaaggcgctcttatcgaccaggaacagcgcgcggttgatgttgctctcgatggccgcacggtcgggcgagagggtaaagaacaactcgtgaaaacgccggatatgttcgcgcgcctccacggggcggttctggctcaaatcctgcgatagcgccagcatcagcgacttgcccccgtccaggacgtagatcttctcgcgctgcttttcggcgaaacggaagctcgcgaccacgctgaacacggataccagcgcgcacaggcagaggaacacgataccgaaaagccgaatctgcctgaaacttgtttcgatgttttttaatgacttgaattccattgtccaaattgttatgaatgattactgttaccttgtgttgccaggttgcgcccgttgggggcactgcccgaagccgggccaccgccgccgttaccggaggaggaaccgccaccgccgcgacgcccgaacgtgcggccgatcatgttgccggcgataccgccagcgacacccgtggcgaatgccccggccttgttgataccgcccatagccccgccggctccgcccgactggatcacccactcggcaacggtggggatcgtgaaatagcctatgatacctataatcaaaaagataatatagacaccgctgccgctgtcgggaatgtagttggggtcttgcagggccaggacgtccgcctggagcatcaacgtctggatcttggccagcaccgcggagaacaggtcggcgatgggaagccaaaggtacacgctgatatagcgggaaatccaactcgcgagcgtcgagtggaagccgtcgtaaatggagagggcgaacgacaagggccccagaatcgacagcacgactaaaaagaatgtccgcagcgtgtcgatggtaagccccgcggcgttgaacaacaactcgaagaagtcccggacaagctgccggaaaccggccttgatgtcgtaccacgtgcgttcggcccacatgctgataatctcgcccaaatccgtgatacccatatccgcaagccgttgttcatacacctcgtcgtccactaaccaagccttgccctcgcgcctgcgggcctcggcttccaaatcgtccttctgttgctggtatgcctgcaaatccaatgtctgcccctccagtatggcgtgcgtgccctgcaccacgggcgacatcacagcgttgatcgtccccagaaccacggtgggaaagaacatcacgcacaagccgatggcgaaaggccgcaggagcgggaacacgtcgataggctccgcgctggccagtgccttccatacccggtaagccacgtaaaagagcgcacccaggccggcgatacctttcgccaccccgatcatgtcgccgcatagcggcatcatctcctgatacaggttccggagaacctggtgtaaattgtcgaaatccatgactgcctccgttttcaggttaccaatatctgtcgttcgggttcccgtaaagtgccagcacccggtgcgcgtcgcccttttcgcggctgcggatgaaggacacggagatggtcttgcgcgtgtaatagcgcgtgaggttgcggtactccagcatcttcgtgtaaacctgatccaccacgtccatccgctccttgtccgagagcgagaggccgttgccgccggttatgaccgtcttgagttccgccaccagcgcaccgccctcctccagcagccgggcgtaacccgccgagatcgccgccagctcgtccaccgtgaagttcgggtctgaaaccatacggttgaatcccgaggtgtagatttccgtgatctcgctgaccatttcgagcgtcagcttcaccttccgggcatccttgatgatgttatgcaccgatttgagggcgtcgtagtaagccttgctctggttataaatcttgatactctcttgcagcgacttgaccatgttggtcgccgtggtcgagctttgaaccgcgctcttgatgttctgaacgaggttcgacgggtcgatgaccgtccactgcgcttttgcctggtacgtgaagcaaagaagccccacgaacagcgttaaaatcaatcgtttcatccttttcattatttaattcgtgaatacttgggcggtcattccgacgcccggtaataatccccgtaggcggagagctggagcacctcgcgccccacatcgtaggccagggcgacatacccgtagaggtcgaagtaacggatacctccccaatacttcctcacgggacgggagaagcgtgtcccgtccttgtaggacacctccacgtaaaaaccgccgccccggcgtcccgggttgcggtagatgcgaacccggggagaacccgagcggctttcccactcgcccgccacctcgtacagcgcgaagtccaaacgcgccgccgtggggtctgatccgatacacttgcgatacatggcctgccctccctttaacgtttgccctcggcgagctgcctgatcgccagttctatatcaccgcccagctcgccggcaagccgctgtacctccactttctccgtttcctcggtcgtgtaggccaggtactccgggacgctgacctccgtggcatagaccgccgactgaacgccgcccagaccgatccagacctccttgtatttacgggaagggttgttggactggttgatcgagagaatctgcgccttctccttgtcggtcagccccaacaaggactgaatcgcgtcgaaacggttcatgaacttgcgctggtcgagcaggatcttgcagtccgagttgttgatgatcgcctccttgaccaccgggctggaaatgatgtcctcgacctcctgcgtcacaacgatggcctcaccgtagtatttgcggacggttttatacatataacgcagatattcagccatattggccgtagagagcgccttccaggcctcctcgacgatgagctgtttgcgtacccccttgagccgtctcatcttgtttatgaaagcctccatgatgataatggtgaccacgggaaaaagctccttgttttccttgatggaatccacctcgaagaccacgaagcgcttcgagagcaggtcgatgttggcccgggagttcaaaaggaagtcgtagcgtccgcccttgtaatattgccgcagggtgatgagcatgttgtcgatgttgaaatcctcgcggctgacccggatctcccgctcctccagctcgcggcggtagtcgtcccgcaggtactcgtagaaactgtcaaaacacggcacgatattccggtcggcgcggatacgctcgatataggcgttcacggcactgcccagctcgccgctctcggtcttcgtgatcttgtcgtcctcggttttccagagtgtcagcagcagcgtcttgatgctgtccttcttctccacgtcgaaatagtagtcgtcggtgtagaacgggttgaaactgatgggatgttcctcggtataggtaaaatacacgccgtcctcacctttggtcttacgccggatcagctcgcaaagaccctggtagctgttaccggtatccaccagcacgacatgcgtgccctgctcccagtattggcggactaaatgattcataaagaacgacttgcctgacccagagccgcctaacacgaatttattcctattcgtaatgatcccttttttcatcggttcgtccgagatgtccaggtgcaggggcctgccgcttacgcggtcgcacagcttgatgccgaaagggctggacgaggatttatagttggtttcctccgtgaagaaacagactgcgggctcgatgaacgtgtagaacgattcctcggcggggaaatcccccgcgttgcccggcatacccgcccagtagagcgtggcggcgtccacggtgttgtggcgcgggcggcactccatcagagcgagctggctgcccacatcattgcggatatgccggagctcctgcacgtcgtccgaccaggccagcacgttgaaatgggcccggacggattgaagaccgaacgagtgcgcctcgttgagatactggtcgatccactccttgtttatctggtttccgcgggagtagcgggaaagggactgcatgttacgcgcacgtttctcgaacatacgcaggttttcgtcgctgtcttccaggaacacgtactggttgtaaaggtggtcgcaggaaagcagaagccccacgggggccgcgaacgacagcaggcagtccgaacggtcggtggaaagacgctcgtaacgggtatccgtacccacgcgccccggcaggtcttccgtgtccgagagcgtgtgcaggcacacccgtttgttgcccacgcgcagaacctcggcccccagctcgatgtcctgaagagaagtcgtctccgagagcgagagggaaaagtaccgctccagcaggcccggacaatccgccgtacccgtgatctcgtcccccgtgaggcggacaagggtcaggaaacccgaatcgttcagaatacgctcgaactgttccgccgcctccaggaattttgtcgccgattcccggtttacctctttgggaatgatgttgccccggcagagggtcgagaagtctgaacgcatgtgcatacgctccctcgtcgttttcgtcaggtagaggaagcaggcgtgggtcaggaacggacgctcgttgaaatgccgctcgtaactgcgggagaggaaactcatgtccccctcgcccgtggccgggcggtaacgctcgcggatgaaccagtcctgcttgtgtaccacgctgtattcgggcaagaccttcagggccttgcaccaggcggcgtggatcgcctcgtactcggcggacgtgacggtgaacagctccgggagttcgacccgataggcgaccgttatgtccgcgtccttgctgatgatacaaccgccttccacggccaggagcgggaacttgctttccagcgtggtggctttcaagatgtttctcatacgcggcccccctttcttttcagcaaccggcgcagggacttgcggttgagcaggtagcggggatgccggcgcgcggcgaacagcttcatcagcccgtgttccccgtaacgggcgttcaggcggaaggtaagccagaccagcaccgaagccgccgcaacgccgaaagcgatacatacccactgatcgacccctgccatgtagaggatgacgaacaccacgaagacggccagcaggccgcccgcgaagatgaagaggtactgcgccttcaggccccggaactccacgctcttgccgattcccttgttgattccatattccataattatttgcatgacaggttggactacaagaagaaagagcgtaggatcgtcgcggcgacaatcaggaaaatacacgcgccgaaccagctcgcggcggtcttcgacgtgtcggggtcgccgctcgaaaacttgttatagaccttgatcccgccgataaggccgaccacagccccaatcgcgtagatgagcttcgttccgggatcgaagtagctggttaccatgttggtagcctccgtaatgccggcgatgccgttgccctgcgcgaaagcggaggagatggcggcaaagagaaatgccgccggaagaagaatcttgttctttctcataactcgataatgtttgaattgtggcgcggggatggataggccccgcaccgggttaaacttcttgattcggattttttcagtggttcgaggatagcctcacgtgctacccgtagtctttttctttcatcgtgatgtcattatggggttaaacaaactcacggacgtcgaaacccgtgggaaccgaaccctgcggagatgggctttccgcagacctctcggacatacgccggtgaaaggccgagaggtaggtgtcgatcagggattttaccctgtcgttcccgtcggggcggcccgaaacgatgacctcgaacatgtcggtctgtttcaggcccaggaggacacgtcccgtttcctccctttgctcgtctgttgaaggtggatcatgtaccacgtggcggtaggcttcgcccatctgttcaaaactaaccccctgggcaagcgagcggcccaaaaggggcagctcttcggtgtcgtcttcatcctcgtcataatccggctcctccgcgtccgcatccgggaaagattcatcgtacagcggaaagtcgatttccagaggttcgttaggctccccctcgggagcgacaccgaacacttcatccaggtcttccggcggaatctgccgggggtgttcgggtacattcgtgggcacaaatatatcggctttttccgtaactttttcagtttcagattctacggcagcttgtggccgggagtggcgcgggtcgaggacaaagcggctcctgccgatgatctcctgccggcagggcgtgtcttcggcaacgatcccgtctgccggttcgttacgttccatccgccgcaggcggaaaaacgcccacaaggcataccccacggcaaagaggggcagcagccacaacgccccgttcatcgctcctccgctttgggttgccgggaggccacggcctcgcgttcctcgaaaagccgctcgatggtttcccggttatcgtccaggtgcgccttgagaaccttgtccacgtaggccgtgatcgtcacgtcgccacgaccgatgacacgggtgatctcgcggatacgctcgtgatacgacggacgtatcttcacgtgcttgttaccggcgaaaggcagccgcagcaggcagatgtaacgggccaggtactcggcctcgggggtggggacagtccccacggcgacctcccccgaagggccgtcggggacgataagggttttcatcctgcgccggtagcggcacacgcggaagatgaagggcacggcgacgcaaaggacggccgccaggataacagataaaataattgctttgtctgacatgatggattgtttttaataggttgtaaatattgggttcataactaaaaaatatcggagttccgtttcttgtagagttccgaaatttcctcctgataggtcgcgaaatgctgctccagcacattgtccaggtagctatacagcgagagttcgttcttaccgataacctgcactatccgggttatacgctcgtgaaactccttgcggatatacaccgttttgccgcttcgggtattggagggggcgttccggataaaaagacgctcgtaatcctggcctttccctcttcggcggcgtccctcctctttcgtagccggcgaggcggcggcctcgccggacggttccgatagagccgatgcctcctcctctttttccggcgtgtaaggatgtaatggccggtttcggcttttggcctggctgatgatgaaggaagcgtccaaaccgtcgtcatgttcttttccgctcataagatcctactttaacagttcgatcaattcatccacgagtttatccaggttgctgccccggatcaaagaacggtctgccgggaagagcgtggagcggaagacagagcgacggctggcgttctgctcacgacgaaaacgcttggtgtcaggcaggaaggtcttcagaacaggaagacccagctctttcattaccgcctcgtaaacctgatataactctgtcttttcacgtccgtccaccatgttccatagcatatacagccctttcatccgggacttctcgcggcccatgatatgctcctttaccacaaccgcgtaattcagggtgctttccatgacaacccggtcggcactgatcggggcgacgagataatccattccggccagggaatgaatcagatcctcgttattgatcgtaccgggaaggtcgaagaacacataatcgaaatcaccttgcggcaggaggtagtcggcatcggccaacgcctctttcgtgttgctttccacgacaggataggctttcttttgaagccgggtgaattgttcgtaagctaacctcttgtaatgttcgtcttcgagggcaagcttcaggtcacgttcccgcatctccacgatggagtgttggggataatcgcagtcgatgaccgcgacattgaaaccctttacatagtgcaggtaagaggctgccagcaccgtgagggtggttttgcccgctccgcctttctgggtggagaaggccacgaatttcgttttctctttcattgttccatgcgtttttagttatacaatcgggtaatcgttcatctcttcacgtatccggacaagtgacggcatgagattttatgctggtatgccggcacgcatatatgctggtgcgctggcaggctgttacgccggtatgccggtgcatgggcgcgtgtccgattttatactcatgcgcaaccgcatttgcttatccggacaaagacccgctttttcctctgcacacgatgttttctgcatccgtccacacgtgtgcggacagggggatgtgtcattgcccgtatccgttctcacgtgcaaagtaaacccttaaaaacacgggttgtatgctctttttccgctatggccgcgtgtggcgtcaaagtggacgcaagtggcgtaatcgcttatggcacaagtgattgaataggtcggtatctttgcctcgtgaacgatcccgacgctaatgaagccgtccttgccccgttttacggcggctctttcaatgttctgtccgcgagcgggcagaaggtatttgcaaagggcaaatagcaagctgtgttttctgctgcacgattctcgttttgcagcagaaaacagcttgcccgcaagggggagaaagcacctccggagtcggtgcttttcagaagggcggcaggccgcgaagggatcggaattttcaggaaccggtggggctctggcctctccttaaaatttcgatgcgatggaaaagaacagaaagccccgagggggcaaagggggacgacccgcgaaaaacgacccggccgtttaccgcttttcggtaaacttttcagccgtggaacatgcccgtttcctcgacctttacgagcagtccgggctattgtccaaagccgcttttatcaaagcgagagtgttcaacgaggcgttccgggtggtaaagaccgaccggggaacgctcgaatacgtggcgaagctgaccgctttccacgcccaattccgtgccgtgggaacgaattacaaccaggtggtgaaggagctgcacgcgcatttttccgagaagaaaacactcgcgctgctctataaactggagagagcgacacgtgaactggcggccgtcgggcagcaggtcgtgtcgctctccgaagagttcaaacagcgatggtagccaatatcaccaccggaaaagacgtgtacggcgcgctggcgtacaaccaggagaaagtcgatcggggcgacgggaaagtactgctgacccacatagtgagggagccggcggatgggcgcttcaacgtggccgcgacggcagaagacctcctgcgctggatgccctcgcactaccggacggaaaaacccgtcgtgcacgtatcgctcaacccggctcccgaagaccgccttgacgacgggcagctcgcggagatagccggggcctacatggagcgcatgggctggggaggacaaccttatatcgtattcaagcataccgacatcggacgggagcatatccatatcgtgtcggtgcaggtggcccaggacgggcgcaagataaacgacagcaggcgcaacgaacgcagcgtggccgttaccgaggaactggaacgggagtacggactgcatcccgccaaagggagaaggcgggagaaagggcaagggatcgtccccgccgattacacgcggggcgacctgaaacgccaggtggcagcggtaataaaaccggccgtggcgacataccgcttccagaccctcggcgagttccgggcattgctgtccttatataatataggtatagaggaagtccggggagagcggaacggaaccccctaccggggattgctctacacgctgctggacgagaacggggacaaggcagtggccgcgccgctcaaatcctcactgttcggtaaagaggtcgggtatgacgggctggaacggcacatggagcgtagcgccgaacggttcgggaaggacgacacgaggaggcaaatccgtggccgggtcgataaagcgcttcggggagaacccacggaggaagaactgcgcgaacgcctgcggggagcccgggtggatctctacatacgacgcaacgaaaacggccgcatcgtgggtgtgacgttcattgaccacgaaacacggacggtcgtgaacggatcacggctgggaaaggcatactcggccaacgccttcgagctgcgcttcggcggaaaacggaatcccggggaaaacacgaggggcttgtccccgaaacaagcgcctgccggacgggacgggcaacggaagcggaatacctcacgacggaggaaagtataacatctcaattatcattcatttattaaatcttacggttatgcaacaggaagacgaccttcggggtcttgctaaaacaatggatttcatgcgggcattgagtatcttgttcgtggttatcaacatctactggttctgctacgggcagatacgggaatggggaatcaatatcggcgtggtcgataggattctgctgaacttcgaccgcaccgcggggctgttccggaatatactatggacgaaacttttcgccgtagtgttcctcgccctttcatgcctcgggacaaaaggagtaaaagaggagaaaattacctggcggaaaatcacggcatcgctggccacgggaggcgtgctgttcttcttcaactggtggctgctggacttgccgctgacggcagcggcgaacgcggctttctacatactgaccctatcggccgggtatatctgcctcttgatgggcggcgtgtggatgtcccgcctgctgaagaacaatctcatggatgaccctttcaataacgagaacgaatcattccagcaggaaacacgcctgatcgagaacgagtactccataaatctgccgacgaaattttactataacaaacagtggaacaacgggttcgccaacgttgtaaacccgcaaagggcttgcatctgcatgggaagcccgggcagcgggaagagttattgtgttgtaaaccagtttattaaacagcaaatcgaaaagggctatacccaatacatctatgactacaagtttcccgatctttcggaaatcgcttacaaccacctgctgaatcaccagaaaggttacaagaaaatcccgactttctacgtcataaatttcgacgacccgcgccgctcgcaccgctgtaaccccattcacccggacttcatgaccgatatttcggacgcctacgagagcgcctataccatcatgctcaacctgaaccgaagctgggtgcagaagcagggcgatttttttgtggaaagccccattatccttttcgcggccgtgatctggttcctgcgcatctacgacaacgggcggtattgtaccttcccgcacgccatcgagttcctgaacaagcggtacgaggatattttcccgattctgacatcctacccggaactcgaaaactacctcagcccctttatggatgcctggctcggaggcgctcaagaccagctccagggccagatagcatcggccaaaattccgctttcccgcatgatttcgccccagctatattgggtcatgtcgggcgatgacttcacgctcgacatcaataacccgaacgatcccaagatactctgcgtggggaacaatcccgacaggcaaaacatttacggagcggctttgggattgtataattcccggattgtcaagctcataaataagaaaggccagctcaaatcgggcatcatcatcgacgagctgccgacaatctacttcaagggactcgacaacctgatcgccacggccagaagcaacaaggtcgccgtgctgctgtgcttccaggatttttcacagttgaagagggactacggggacaaggaggccgccgtcgtgatgaacacggtgggcaacatcttctccgggcaggtcgtaggtgaaacggccaagacactctcggaacggttcggtaaggtattgcagaagcggcagagcatgacgttgagccgcagcgacaaatcgacatccatatccacgcagctggacagcctgatcccggcctcgaagatctcgacgctcacgcagggaatgttcgtcggggctgtggcggacaatttcgacgaacgtatcgagcagaagattttccactgcgagattgtcgtggacaacgaaaaagtgaaagcggaaacggcccggtacaagaagataccacaaattaccgatttcacggacgagaacgggacggatcacatgaaacaggtcgtgcaggaaaactacgaacgtatcaaggcagaggccggccgcatcgtcgccgaggaactggaacgtatcaagaacgacccggtgctttgcaagctcctgccggaacagaactaaatgaacacaaacacccccgcaaacaccctccgttaccttaacgggggctgtttcttggttttataaccgcacagccggtgttttggagcataaagtagtgattatgtgaacagaaaacattatttttgtgttcggaatccttttaattataagtatgacagttaccgatatatacgaagcaatgaacagcaaggcggaagcgtttttcgagtggttgcaggctcacccgaaatacgggttgctgtttggtgtcgggttgcttgccctatggcttgcagggttgctgttccgttggaaatgggcgtgtcattggcagtttaacagcaaactgtggttatttgacgattgcaagcctgaaacacgccgcagggttcagattgtgttggtcagcgttctgattatacttatattggttggtttctttgtatggagataacggtatggaaaaggacaatcgcaaataccggatctgcttcatcgactatatgtggtatgtagccgagatatggcacgaaagggagcgtaccaatctcaacggacgtatgctactgttttggtgctggctcttcgtcctactcataccgcttggggttccgccgatattgcgccttttcggctggatgattggtttggccatagtgattcctctctgctttcttcccgatttattctgcaagctacgctatacagccggacggcgtgaagcgctccgtgaacattacgggaagatgaaacatcccggcaggaagctcgccaaaatagttcttatcgctatcgccctgatcgtggcaaatgtagcgctgatgttccacctcggatttatacattgggcatgatgaaacggcaggagaataagcaacggttctatctctgggactacctctggtggatgggggagaaattggaacaagcaagacgaacaggcagggtcgatggcgaaatgatgctctcgatttatatcttcgctcttttgatattccctatgatgactgttactatccggctttttccaggtgtgtcggcattgttgccatgtgtcgtttttagcattgtcacatttgccgttatgtcgctcgtcagcaggatttacaaatggcgaggcaaagcagtgatgtctcactatgccaagtgcaggtttaacgaactccttgcggttctgttatttttccttgcgatagccattatctgctttatgatgtatcttcttgacaaaaagtgaaacaagctttgatacgaactccgggccgttatatcgaatggtctaactcgatgtaccagtttcccttgatgggtttgtaaagcgtggtgtcgttgtacgtcctgcggtagatctcgttcaggtcgccatattcggtgatacggatattccgacggcttctcaatccgggatcgtaaacgaaactcttggacgttcccgcatccacgatgccgtgggagtagtacggcataacaaggctcacatataccgaatctgccgttccccattccctgcgatcaacaaggataaaaccgcatccaatctctgataacaaggagtcgagtaggattcgctccggcttcaacagtccatataccggaatgtcttgttcgtcattcgttttatggaatgtatcgctttgttctgttgaatcaagtataatgacctcttccggagaaagcggcgggtagtgaaaactaccttctgaactctctgccatgatttcgtacaccttacggaacgccacctcgtgcgtggtgaaatggcgtatcatttcctcgtccgacggcggcatgggaggctctccgcagcttgcggcaagcaggattacaaataacaggattatgattggtgttctcattttctaatgtttaataggatgcagataatcactgtttaagtgattgatgtgcgtgttatcaatactttaactacaaactttaaaacaatcattcattttataataatagtttcgtatctatcaaaatgtattccttgaagatgatgtttcaatacaaggttcttaaattcctccccataaaaagtatagcgacaatttacattcggaagtctgaaaatagtttgctcttggattttatttttatccaacacaaatttatttatacaactcacccatcctctttctttatctaaccacactatatctgattctttttcaatcaaagcatctattatattggtacaatgaaaaaaataaaaaccttttggcgactttatatcaagaatttctccatttttgataagaatattttctaaaatacttaatgctttgtcgctaatagttaatagaggattacaaaattgtgataaatcaaaatgtttatgtctattactttttttccatatatattccatctcaggaggattccactgctttagtaaaccttcagcatgtcccatacaattttgccaatcttccacatttggaaaacgtaaatcgttaaatccttctaaactacctattaagtaaaagttcatattgtcgtactgtaattgataatggtttgacggggaacggcgttagtccgttatcccggcttgttaatattaaatttatgtttcctgatagattgtttcagaatataattctgtcgaaagaataatagattttaattctccattagacttataatcaaatgaatgttgtaacgtatcctgttcaatatcatttctatcaaattgtcttataactattttttgtaggcggtcattttcataaaaatatgtttcttctctacttccacgagaaccctttgaatacattttctctattttaccattacttccatatagataatatcggacattcacaatacgtttgctattatcatatgcaatagttttcatgagttccttttcataaatgaaaaaggtgtaatagaattgatttttaagttccaagccctctcggatttctataatttgattttttacatcgaaataataagtaaataggttattagttgttttgagagaagttacatttccaactattttcccttgcttaaacctgtttctttgataagaataaggggatatttcgtagaactcacctttgtaattctcttcccttacaacattcttatcaatttctcttttcaattcatcaaacatatttctcaatgaattaaaatcatctttcaatttatcaggtatcatagtgtttccttttaatattaatgtttggtggctaaccgacctttcaggggtagttaagccgcttgttagcaacctcttttcgttttatagattatttcagaatatccatttggaaatgatttggtaatactttctaaagccccatcgtcttgatattggaatatatgaattaaatcattaccactattaccctcaatatcatattgtttgacttcaatatgtgtcaaagcattttctttatagatataattctcttcacggcaaccatacctaccacataactgtgaccgtttcagctttccgccctcaaaaaagtaatggcatacattcatcaaatgttttccattatcgtatagaatacttttcacaagattgtctgtataatacaggaaagtgtgataaaactgattttcaatagaacaaccaaccttaacttctacgatttgattttggttattaaatccgtagatacaaagatttttggtgctttttattgtatcaggacgctttacaggttttccttgtttgcaaccattacgctgataggaatatggagtaagttcataaaactcgcccttatacaactcagtcctgacaacatcgtcttctatttgttgccttatggtttcaaagtcatttttcaatgcttcaaattcagttcttatagtttctccaatcattttcatctttttggggttgctaatgttcggcagcgttccgcttattcaatcggtttgctgtttgttatcggtctatttcttctgtttcaatcttgcctccaagttgttcaatttcttttcgatattcatccacaattatagagttccctattccaagtaaaattttatctcttgaacaaaattccttgatttcacttagtggaacagaaaatttcttttttaagtacagcataattttaggcaattcatttcccttgtctgcaagatatatattgtaaatcttaggactaatgattgtcagataatcatctaattccgtattctcaaattgcacaaactcggcagttggtaatattgcataacgaaaacaatccgattttgtatcacaaaacacaatggaataaccgcctctgttaagttgcttgttcatagcttggaacaacaaaggcaaatagtcacctcggcgaattttgtcccaatccaaagaatcctcaaactttttagtgttccataagaaacgttctatcccataattctttaacatcatcgtaatggaacgcttaacctgccctgaatattcttcaccactccaatcaataactgccattctgtgagaaactatagcaaaacaaagcataatatctacttcactaaattcattgtcttcagagcttgtatcgtaccatcccttttcaaacattttcctatgttgaaggacaaaggttctcttatctatattgaacaactgaatcatttctaaaaattcatcatagtgttcttttaataacactttagcgaataattgaagtttactatccatattttaatttttagaccgataatgtttgttggataatcgacctttggaagattaatccgtatgctatcgtttatttcaacttaattagtttttcatattgacaagaaacatcaagaagtttatctactaattcatctccaagccaacaatctattagatatttgccataacttggtgtaaacgagtaaatatctttatcaatcgcattaatcatattttccaattctttttgtacattatgtaatgcaccatcaggaagagaagtcttcctacattcaaaaggttgcgctaatattctttttacatcatcaagtatattcacacaacaactttttactgtttcttttctacttaccatattaaacgataatgtttggtggctaaccgacctttcaggggaggttaagccgcttgttactaacattttattgtgtcaattcattattagttttacaacagaccaatgacatttgcaacaatatatattgtcgctatgttgttctataccttctatatctatcattggaagttgtaatttctttcctttcatcacaatctcaaactcattgaaatgccaatctttaagttcttgtttttctattgtgaagccacaactctgtaaaagtgttgtaagctctattataggattgcatattgatttgtattgacacatattattttttccttgttagtaatgtccggcagataaaccgccttcaatgtttcatctgtttgttagcaacctattttctatcaatcttttgtaaaagttgattgtaatacttctctaacattttgatgttattttttctgtcaatttttccactttcattatctgtgtatgcaaaccacttaaatagcaattcaacaaaaatatgtttaccaatttctgttaaagaactttccttaataattgaaggcatgattaggtttccttcattatcacatggattatcacacaaaagcccctttccgtatgcgtagtttaataagttctgacaacagacttttgcgtagtctttatctctctgacggatttgagcttctataagtccgtcaacatcaaaaattatttggtcactcatattctttttagtttgtaaagttgctaatgttcggcggataatctctcttacggagatttatccatttgttaccgatgtgccatttatttctatttctttaaattttaaaaactcatttgccttatacaaatgaagtaattgcattttcatattttcattgacaatgtttttataaaaaccgtatttattccacccttttaaaaagaacccatctacagatgaaggtattttagacatatctaacacaagtgtactcatgcattcaaattcttctcgtttggaatgaatattgtcaacacaatcaattacttcattaaaaataattgccatataatcaagtgggaaatctccatatactgaaaccctttttaaagaaattccttttatggaggacaattcgtttatattcaatatatcttctctgacaagaaacaaatggctgacttcagcaaattctggcattcttatttgcccaaatccagatatacttttagcgattagccccttacctttgataagagcttttatctgatacctttccgatgaagatgaatctataattctttgaaaattaatttctttatcttcatatataaactcccacgaatatgtaatacatttcttccatattcgattttctccattcaagtatattttataccatttcatattgtcattgttaatcggtaatggtttgcagcttgccgccgtgaggtggcacaggtgcttgttatcagtcacttttatttcaaatcttctttatttatagtaattattctattcggtataaagaattgagatgcttccacatctatgctgtttgatatatagcacttccaaaatttcacgtatagaaatttctttttgattttacgaaaaaacttggaaaccatttgagaaaaatcattattatcagaacagcaataaaaacgtccagcaatgtatgccatatcttccctttgaaaaggaactctatattctaaaactggacttttcacatagtccaatacttcagctgttgttccatcataatattcatgtgtataatatgatatatattgttggaaagattttccggtcaaatacatcttccggtcattagcacaaatgtcaaaaggagataaatctcctttataatgtgggacacacaacaactctccaaatacacttctaagcgtatttgcaatcatctcatcatcatttttatgcgaatagaattcaaattgctttcccatgttctactggttttaatgactgataatggtttgcagcttgccgccgttaggcggaacaggtgcatgttattcgcatattattcgggtcgccaatatggatgtaatgccgttccaatattaaacattggaacattaaactcatttatccattcaaggcgagtccaaatgccagagttttcaccgaccataagcatcctttcattacaaaaaacagcttccatttcataagggcgacgaccaatttcaaagttcattacaataaatctaactggagctttatcttgtaacggtacaacaaccgaattgcattttaaggtggattttgccactttacctaatgtctttctactatgtcttacagcctcaatagagcgtttggcatttctcgaaatcgccataggtctatatatcggaccaaattccggctctacatcatttggcaggacatccattttatctactaactttgtaagaccgtcaatcatcatttcttttatttcatttgaattaatattgcaaaatcccgcccatgcaacaagctgtttgtcggtaggaaaactctcgccgtccacatcaaaccacacattaaaatcgctgcccaaagaattgatatagataggggatttggctgtatatagtccccaatcatcaatttgccaaagcgagcaatcaaagtttgatatatagtttttttcttccatttgtttttgcgaataatggtttagcggggaacggcgttagtccgttatcccggtttgttatgaacttactttacctcttgcgcctttttataatttacatagcgagcatttagagtgtcccgccattcttggcttgggcaagagtttattaactgaatatacttattctcatcatcaacgcaaacagactctacaagttttaataaactccactgcaaatcataaaaagcattttcaggaaagatttgtaccaacaccatagcttcatcaaatgatatgggaagttgtatttgttctaataaggcatcataagtatttactaattcatcaatactctctgtatcattgatgctttcattaggcatacgacctaaatctttcaactgtaaaatttcatttctcatatcgtgtactctaattgttcataatgttatactatcagccgatttggctgttattttctttaagtatcagacctcgtcttcctccatcaacagatcgtccaacgggcttttgatattgcttttgaaagtgtcggctatgtggacatacctttctgtcgtcttgatattgttatgtcccataagctctttcactatcttgatgtcggttccctgctccagcaggtgagtggcgaacgaatggcgcagcaggtgcggataaatccgtttcgtgattcccgcttcccgggccgctgccttcagccgtttcgacacgatactctcggtgaaaggttctcccggtctgtgttcaaaaagccacactttcggtttgtatagtctgttatattccgtcagctttttcatcaacggtcttgacagcagggtgtagcggtcttttttccctttaccctgccgcacccgtatcagggagcgggattcgttgatgtcgccgggtttcagttccagcagttcgctgatgcgcaaccctgcggaatagagtatggagaacatacagaagaaacgcaggtctgtcaccgtcacgtcgagtattttctttatttcctccttgctcaacacgtcgggcagcgtcttctcccgtttggcacggttcaccttgtaacaccgccgttcctgaccgagaactttctcgtaatagaacttgatggcgttgatacgctggttttgctggcaggaggatatgtttttctcgtggatgagatacagcaggtagtcgtttatctcgccgggagtaaccgtttcaatcttacgcccctcgaaatgctgttggaaatcgcggaaataggaggtatatacccttacggtatggtcactgtaacgcacttgctgaagtttttccagatagccttccggcagtggcggccgtttgtcttcctctttacggggtgcggtttccttgatggcagaatagtctataaacgccatttttacatagcggtcgaagaactcggcaagcacgaaatcttctgccggcagataagccctgccgccgacaagcagtacgttttcttccttcgacagcgacaagcggatgtcattgtcattaccgaaagtcacttcgacaaattctctcccgtttcttatcaccggagaaagtttgatcttggtttttggggtatatatttccatgcctcacgttttgtcggatattgaaacccgttttcgcaaatttataaaaaaacacgggttatccatgcgctttattgacatttaacaatagatcccgactacctgacaaataaggtgaggagccacgaaaataccctctgccaaatccgtccttcccggcactccgtttctccgatttcctctgccctgcgccacaagcggccacttctgtgcccgatgcttccatagcctttccaactcttttacgttcagccggttccccttactttcgttcccgcatcgctattggtgctaactaaaaacactcgtaattatggacgaaaacgtaaagaacgacgctaaacaagtcatgctcgttcagaatgccgacgacggacgactacaagccgttaccggcgtggatcaggacggcaatatccagaccgccgaccccacggatcagaacgtggcgagcctgctgaacgtgaacacgcaggattcagccctcgaagccttcttcaaaaagttcatggaacaggcccagaaccccgtccacacgggtatcttcgtcatgacggagaatgccctgaacaaacttatccgcatcgacttcgacccggagattctggaaaattaccgtatcgacccctccgaacggctccagacgcaggagcagcggcagttcgagccgctggacgtcacgaagatagacctggcggatatggagaagaaaggtatccgcatggaggacatcgagccgcacctgaaagccatgtcttacggacataaatccaacgggctggtggagatgaaccccgaactggagaacgggatgcgtgtttccaccaaagggcgcgtgtcgctcgaagagcaggcggacggctcgctgcgcgtcgtgccgcattactggcaggaacgacccgacctcgacgcccccttccacggggtgctgctcgatgaggaggcgaaaacgaacctgatgaacacccgtcatgccgggaaagtgatcgacctggagctggagccgggcaagctcacgccctgctacgtgtcgatagacaaatggacgaacacgctggaacccatgcccgtttcgttactcgaaaaacgtgcccgcatcaaggaggccgacctctcggaaggcaagcagatggatttctacggcggcggcaaggtgttgctcgaaggatataccacccgcgcgggttataagcgggatgcctatatccaaatcgacgcggccgaacgtaactattcctttacctacgacggtttggatcgcaaccgctacgcccaggagaacaaggagatttaccgccagaaggccgccgagaaaaacggacggcaggaaactacggcctccgaacgacagcccacgctcacgattcaccggacaatcctcaaagcctccgtgcccaaagaggcttatgaccagtggacggaagcggtgaatgatccctccaagcgggcggatgtcaaggctttctacatcaagggcatggtcaaggacgggcagggtgagccgttcaacgcctgggtcaagcccaacttcgagcgtaacaagatggacttcttccgctggaatcccgaccgtgcgaaacggcagggggcggaggtcaaacccgccgttgaaagccgtacccaggtcgccgtcaattccgagggcaagaccgtcgaagcggtcaaaggtgtgaaagagccgctcaagcagggacagcaggaggccaccccggcgcagaagaaaaattaccgcagcagcaaaaagagcaactccaaaggtgccaaggtataacgtatgaaatggttctacatgcaggccggagccatgccgctcctgatcgcggcgctggctgccttgtacctccggccgggtaaacgcagccccccggagaaggcggacgacggacggctgtattacgacgggaacggcaaccatgtctattacgaccgccggctgatcgcccgtccggaaaaagagaaagaagaagaacaacaagaaaacaaccactgaaaaatccgaatcatcatgcaagtaattatcgcagaaaagccctcggtggcgcgtgagatcgccgccatcgtgggagccacgaaccgtaaagacggttttatcgagggaaacggctacgccgtaacctgggccttcggccacctggtcgggctggcaatgccccaacagtatggcatcgcgggtttccgccgggaaaacctgcctatcctgccatcatcgttcatcctcctgccccggcaggttcgggagggtaaagagtataaggccgacccgggtgtcgtgaagcagctcggtattctccgggaattgttcggcatggccgagcgcatcatcgtcgcgaccgacgcggggcgtgaaggggagctgatcttccgctacatctactcttacctggaatgccgcacccctttcgtgcggttatggatcagcagcctgaccgaccgggccattcgcgaggggttacaacacctccgccccggcaacgaatacgacaacctctacctctcggccaaagcccgcagcgaagccgactggatcgtcggtatcaacgcctcgcaagcgcttgccgtggctgccgggcggggtgtctggtcgctcggacgggtgcagacccccacgctggcgatcatctgctcccgttacctggagaacaaggcgttcaagcccgccgcctatttccggctgaagctctccacggcaaaggagggcacggagttcaccgtcctctccacggagaaattcgacggcagggagaaggcggaagcagcccgcgccgaggttatcggcgcccgaacggtacgcgtcgtgaacgtggagcgcaaggaggccagggaacagccgcctctcttgtacgacctgacgacactccagaaagaggccaacagtcggtatggtttttcggcagaaaaaacgctcgacatcgcccagtcgctttacgagaagaagttcatcacttatccccgtaccggctcacgctatatatcggaagatgtggccgaggagattccggcactcatcgggaacatgacacgctatccccgtttcgcggaatacgcgggcaggatggataccgcatctctctcccgccgaagcgtggacaacgaaaagatcgccgaccaccacgcgctgcttcccaccgagaacctcccttccgaactggatgccgaccaccgcatcgtctatgagatggtcgcggggcggatgctcgaaaccttttccggggcctgcgtgaaagaaaacacttcccttaccctgcaaagcgcgggacatgatttcacggcccgcggcagtatcatggtcgagacgggctggcgggccgtcctgaatgaacctgtcgaggagaaagaggaggacatgaccctccttcccgacatcgtgcaaggcgacgagctgcccgtcaagggatgcgtcacggaacagaaacagacccggccgcgcccccttcacacggaatcgagcctgctggcggcgatggaaaccgccggacgcgaactgtccgacgaggccgaacgcgaggcgatgaaggatgccggcatcggcacgcccgccacccgtgccgccatcatcgaaacgctctttgcccgcgagtatgtcaggcgagagaaaaagtcgcttgtacccacggacaagggactggccgtgtatgccgtggtcagggacaagaagatcgccgatgtcgccatgacgggcggctgggaactggccctctcgaagatcgccaccggggagatggacgccccgacgttccatcgcggtatcgaggtcttcgcctcgcaaatcgccaaagaactgctggaagcaagaatcgacggcgcggagagtgacacagcctgcccgcgttgcggcaggcccgtggtgttctatcccaaactcgccaagtgtcagaatcccgattgcggcctgaccgtatggagaaccgtggcccgcaaggagctgaccgacaagcagctcgcggaactgctgaccaaaggcaaaaccggcacgatccggggattcgtcaaaaacggcggcgggacgttcgacgcggccctcacgctcgatgaccagttcaagacctcgttcgttttcgaaccgcgcgatactcccaggcagggaaagaggaacaaacggaaataatcgttacctttgccactggaaaagacctgtcataacgagatacgcttgtttgataaggattttttcagtggtcggcgcttcgggtgggaacccggggcgcctttctcttccccgattatcaacgaccactaaaaattcttatcatgccagacaagcaacaccatacccccacgggggaattgtcctattacggactttcgttactatcctacctcaaggacagccacccggaactcatcgccgaaagtgagttcatcgccgagcgggccgacagcgccgcccaagcgtacagcgaggcgatccgttcgggctgcaaccacatcgaggccgaagaaattgcccgcgaggaactctgccgcggactgcacttttcaccctacaacacgctggtaaacatcctctggagggaattcgaggcggagattcccgaggataccgcccggcaggcggctctacgcctgctgcccctctgccgcggggtgctggagaagtacgacctcacggacgacttcgccgacacgcccgactatgaactgttctataccgaactgacgggaaccgtccaaatacttctcgaagatggcattcaataagaaaacccacctccgccagaatatcgacgcgctgaagacggccttcacgctcgacagggaacggcgggcgccgactcccgaagaagaaaggacactcggcgcatacagcggcttcggcgccatcaaggaagtgctggaaaaccccaccgggaaaccggacaaggacggcatggcaacgctcgtggccgagttgcaagaggtcatcagggcgaacacccccgacgaacgggaatacaagcgctacatggacgggatcaagaactccgtcctgacggctttttacacgcccccgaaagtggcagacgccatcgtggaggcgatatgggatacgcggatcgccccccaacgtattcttgaccccagcgcgggaacgggggttttcgtcaatgccgtggatttccacgacccctacgcggagatcacctgcttcgagaaagaccccgccacggggttgatcctgaagcacctgcaccccgaaaaacgggtgcgggtacagggattcgaacgtatcgaacccaaatacgccggttactacgacgtggccgtgagcaacatccctttcggggacgtggcgctcttcgacccgttcttctccacccataccgaccccgtgcggcggcaaggcacacgggcgctgcacaactattttttcatgaagtccgtcgatatggtacgcgagggcggcctggtggcattcatcacctcgcagggagtattgaacgccgagcagggacgccccgtgcgcgagtggctgatgaaccgctgcgagcccgtatcggccatccggctgccgaacaacctctttacagaacacgcggggacggaggtcggcagcgacctggttatcctgcaaaagaaagccgccacgggggaactgtccgaacggcagcgggatttcatcgaatcccgcaagctgtcgaacggcatccggataaacaaccttttccagtcgttcgacagggtgatccataccgaggccaaagtaggcaaagacccctacggcaaaccggcgatggagttcacccacgcggagggcgtggacggcatcgaccgggagatgcggcgtatgctctcagaggatttcaaccggcatttcaacgagagttattgcctggaacatgctccggaacagacacccggtacaccggagcgggaattgtcccgtccccgtcaggcggaacgccagcgtgccgaaagacacgagccccgccttgccggagaaatcgtcaaggagattatagccgacgcccgtaaccttcagcagcagcgggaagaggaggaaaaacgccgcgtcgtcgccgaaatggcggcgcagggctaccatgtcgataccgaaaccggggagattacccgaatcgaaaacaaacccggacaagcgttaccggattctgccgccactcccgccggagaaccgaccggagaggatctggccgacttcggggcctggtcgaaagagcgggagaatcgcttgtgggagcagcacccgccgaaacccgaagatttcggcatggcagatactcccgtgcagcacgtgggcggaacaacggaaccgaaaccgcaggagggcttcgccgggtcgcttttcgacacggtggaaacggcggctcccgtacctgccacccaagctgccgaaccggtaaacgtgcagcaggaaccgttgctgacgctctacgatctgttcggcttcagcgccgaggagcggcggcaggcagaactcggtatatccaagaaaaggaacagccgccggggagcaaagcggaagacgccccggcaaccctcgttattcgccccggcctcctctccggaggaacagaagagcgaaatgccgaaaacgacgccaccggagcgtgatcccgaagacttgtatgcctccctgaactgggaggacaacccgccgatcaacggcttttacgagatgatgatgtcgcttaccccggaacggagggcggaattgcgccggcaaaacgcccggcagcaggaaaccccggaacagcgggaacggcaggcggtacgccccccgacggaagccccgaaagacagacggaaacaagccgccggtacgccgagaacgggcagcctgttcgacacgccggacaatccggaggaggaagaacccggtaaagaaatgccgcagatacgggaggcggatatgaaaccccgcccgttcgagggtgaggtcgccccctatttccgcgaagggacactcgtcacggacggacaaaaccgggtcggctacctgcgggggattgaatccctgcaacccatgttccacccgctggaactcacgcctgcacaacggacgaaagcctccatgtatatcgagatacgcgatgcctattaccacctttataacaacgaggcggaaacgctgacggcgaaccccgccctgcgggagatgctcaaccggctttacgacaatttcaccgaacgcttcggacggctcaatgacaaacgcaacctcgacctgatcaagatggacgcgcgggggacggagattctatcgctggagcgttacatcgacggcaaggcacgcaaagccgacatcttcgagcgtcccgtggccttcaatcccgatgagatcacgcacgccgacgacgcttcggaggcccttgtggccagcctgaacaagtacggccgggtggaaccgcactacatggcctcgctcacgggaactaccgtggagggaatactcggggaactgaaaggacgtatctattacaacccggaaacggacggctacgaggttgccgacaagttcatcgccggcaatgtcatcgggaaagccgaacggatcgaggcgttcctgcgggagaatcccgaccacgccccggcccgggaatcgctggaggctctgcgcgaggcgacgcccaaacccatcgctttcgacgacctggacttcaacctgggcgaacggtggattccaaaaggtgtttacgagcgtttcgcctcctcgctcttcgatacggaggtgaagatcaccttcgcctccaacctggacgagtacggcgtgaaggcggaagcgacgaacgtgaagatcacggagcagtatgccgtcagcgcgcagacccgtaagtacaacggcctgcaccttttgaaacacgccctgcaaaacacttcgcccgacatcaccaagaccgtcctcaaatgggtggacggcgaacggcgggaggtcaaagtgcgtgacggggaggccatacagctcgccaacagcaagatagacgagatccggggtgctttccccgaatggctgcgcgagcagtcgtccgacttcaaagaccgcctgacagacctctataaccgtactttcaactgttacgtgcgcccgaagtacgacgggacgcaccaggaattccccgacctcgacctcaaggggctgggaatagacaatctgtatgacagccagaaggacgcgatatggatggacaaactgctcggcggcgggataatcgaccacgaggtgggcggcggaaagaccctcatcatgtgctgcggggcctacgagaagaaacgcctcgggctggccaataaacccatgattatcgggctgaaagccaacatccatgaaatagcccggacgttctgtaccgcttacccgatggccaaagtcctctacccgggcaaggaggatttcacgccccggaagcgtgagcgcatcttccgggagatacgcaacaacgactgggacgccgtgatcctctcgcacgaacagttcggcatgataccccagtctccggagatacagcaggagatattgcaggccgagctggactgtgtggaggagaacctcgaagtgctcaaagcacaaggcagggacgtttcccgcgccatgatgaaagggtgtcagaaacgcaaggccaacctggaagccaagttgcagaaggtggcgcacgcgctggaaacacgcaaggacgacgccgtggacttccgcctcatgggtatcgaccacctctacgtggacgagagccataaattcaagaacctgactttcacgacccggcatgaccgggtggcgggcctcggaaatcccgaggggtcgcagcgggcgctcaacatgcttttcgcgctgcgtaccatacagcagcgcacgggccgcgacctgggggcgacgttcctctcgggaacgaccatctccaactcgctcacggaactgtacctgcttttcaagtacctgcgcccgaaggagctggagcgtcagaatatccgcaccttcgatgcctgggcggccatatttgccaagaaaaccatcgactacgagttttccgtgaccaacgaggtcgtgcagaaagaacggttccgatatttcatcaaggttcccgaactggccatgttctactccgagattacagattaccgctcggcggaggatatagggatcgaccgaccgcaaaagaacgagatattgcacaatatcccgccgacaccccagcagacggagttcatagaacgactggtgcagttcgccaaatcgggcgatgccacgctcctgggccgcctgccgctctcggagcgggaggaaaaggcgaaaatgctcattgccacagactacgcccgcaagatgtcgctcgatatgcgtatgatagaccccgaactatacagcgaccacgtggacaacaaggcgagccactgcgcccgtatgattgccggttactaccgccgtttcgaggcgtacaaaggtacgcagttcgtattctccgacctgggaacctacaaacccggagcggggtggaacgtctattccgagatacggcgtaaactcgcggaggattacggcataccccaaagcgaggtgcggttcatccaggaggcgacctcggaaaaagcgcgcaaggagatgatcgccggtatgaacaccggaaaaatccgcgtactcttcggatcgaccgagatgctcgggacgggagtgaacgcgcagaaacgctgcgtggcgatacaccacctggactgcccctggcgtcccagcgacctggagcagcgcgacgggcggggaatacgcaccgggaacgagatcgccaaactccatgccgacaacaaggtggacgtgatattatacgccgtcgagaagtcgctcgacgcctacaagttcgggctgttgcacaacaagcaactgttcatccgccagctcaagaccaacaacatgggaagccgtaccatcgacgagggggccatcgacgaaaagagcggcatgaatttttccgagtatgtcgccgtcctctcgggaaatacagacctgctggacaaagcccgcctggagaagaagattgccacgctcgaaagcgaacgccaggcattcgtgcgcggcaaatcatcgagccgctacaagctggagcagatcacggagaagatagagaagaacaacgacctgatacggcgtatcggcaaggatctggaacacttcaaggcccgcgtcgagttcaacgaggacggctcgtaccgcaatcccgtgaaactgaacgggctggaaacctccgaccccaagctcatcgggaaacagctcaaccatatcgccgaaacggcacgcacgctcgacaggctcgaacccatcgggagcctctacgggttcgagctgctcgtccagagcgaaacgaccgggaaagacgggctcgacctggtgcagaaccgtttttatgtccggggtgaaggggattatctataccagtataactacgggaatatcgcctccgacccgcgactggcggcgatgaacttcatccacgcgctcgcgaccatcgagccgacactggagaaattccggaaaaagaatgaggaactggagaaagatattcccgtcctgcgggaagtggtggaaagttcctggcgcaaggagcccgaactgacggccctaaaagctgacctgacggaaatagaccgcaggatacagcaaagcctcaaaccgatagaagagagcgagggaaaggaggcggaggaggataacgacgtgtgccgggaacggcatgacacggcggaagagctcccgaaggaagacaacacggcggcccgtattccttcccggctgcggcagattgccgacgcctccggggggcgcatcgtgatcgcgggcgtgggcagcccgccggagaacggccctgcgaagaaagggatcaagatgtaaacgaaaagccgacggaagtacagatttccatcggcttttttcatatgtccgtgagcgttgtcgtcacacttcctgcaagagtgtttgcagctcctcctgcgtgggaagataggtcatgtactgggcggcgaagacctgcttttcatcttcgggcagcgtataacggacgaccgcgtcgtttttctccgcgcagaggacgatacccaccggagggttatccccgggattcatcaactcacgggtgtagtaattgacatacatctgcatctgccccaaatcctgatgggtcagctccccggatttaaggtctattaaaacgaaacaacgggccaggtaattgtaaaagaccaggtcgatgtagaaatgcttgtcatcgaaggagatacgcttctgtcgcgcgacgaaggcgaagcctttcccgagttcgagcatcaagcgctgcaagcggctgatgagcagttgctccagatcggtttccagaaaatgctctccctgcgggataccgagaaactccaggatatacgggtcgcggatgatctctttgggttcgacacgtccgggttcggtacgggaaatctcctctttcacagctttcttgtctcggctggccagcaggcggtcatagaaaagcgtgttgatttggcggtcgagctgccggacactccagttttccttgacgcactcgtgcaggtaaaaatcacgggcggcatcgcccgacaccttgagaagcgtgcggcaatgcgaccagctcaatttatcacacagcgtgtgatatttcgggtagcactggtaaaactgcctcatgtaccgcaggttggtggccgtgaacccgtttccgaactccgccacgagccgcctggaaagggtgttgatgacagccttgccatatccggcacggtcggttccctgctgctcgtactccactatgtatttccctacctgccagtaagccctcacgagggtcgaattgacatgatgtatcaccttcgcgcgcgcttcctgcaagatatggcgcacattatgcagcagctcttcctcccctttgtcggcaggatatattttatcagtttctttcattgcttcattattatataggcttcattcagcaaacatactgattttacggcaaatatcgagcggttgtaccgccttgtcgtgccttattccatgtatctccgcgtttttccatgacgccggactctcgggacagggcctaaccggaaccggcaggacgatcctttttcagcttgcggaaattactgaagttacgctcgatgaaccgcaggacgtccgattcccggtagaaggtcttgtgatagatcatctcgtaaggcagctctcccgaggtgcggtaacgctggagtgtgcgcttgctgatattgagcatacggcacaggtcgtaattgtccagaagacgctccccgtcaggcaggatggaaagcggttgctccacgtcccccgcgcacagcttctcgatacgttccagccgttccgagagccgctgcatccatccgtcgaaatattccttgtccagaaacatggcctactcctttggttggttcttgcgccgcacggaacgctccttcagcacacggcggatttccgtgagggaataatacagcttccggttgatggccgaataggtgatcacgtgatccgagcggaggcgttgaagggtacgcccgctgatacccaggtaacggcagacctgctcgccgtccatccattcgtcgtttatatactccttattccatgcacgccccttttcagggagagaggcgattgcagcctctattttctctatacgcccgacaagctcgttataggctcgcgaaccgatcactatgattttcatactcctttgttttttagtctgttacaaaggtcgggcttatatggacagcttaaaacgaggtcggtacgacttttttttgataatttgcagtgaactgattctcaacggttcatgcggtgaagaaggcagtgttttttaccgaaatccgcggcccgtactcggtatttttatgggcagaaatgcgatagaatactgtgattcaacgcttaacggtgttctaatccggacggggctacaacggaacacccgtatcggctccttatacgggtgcaaatacgggcgttcgggaaagttcctttcgagagttacgggggaaaaccgacctcggttcttttgttatatacaacgctgattatcagtgtttctataaggaatagagtgctttaccggttcatattctactcggaattgccgtttttcttgtttcgcttccacgtctgcatacgtttaagcagggcctctttcgccttgtcaagccacggtgtcgggttgtttcggattttcatatcgcagaatgtcctcgaaaggttcatgtcgaggtgtacgttgaaagcgttggaaatgtagctggcaagttgcgtgagtggcacattgccgaaacagcctttactgtcgagcaggtaaataagttccgtcagatccgtcttcgagtcctgccatgtcggacgcacgtcagacaatggcagaaccatgttccggaggttcgtgctctccagtgattccaattcgcccataagataaaccgacaacatatcgttggccaggattttcgccaccttgaaatccgcgtttgtcgaaaactgcgggtcgagttcatagtagaaggtttccaggtattgctccgtgtcggtctgcccgcgcaggaaatagaggctgtccaggtgtgtagcgccgctgcggaaatagcggataaagtcaaggcgtttctgcgtgtacgcgttgatggcccgaacatgggcgtccaggtactcccgttgtgcctcgatacttcctaccggacggttcatctcgatattgtagagcttgcggtaatagatcagacggcaaaaaagacggggtttgatttctttgaagaactttatttcctcgtcatcgttttgaaaacggtagccgatgatatattgtttcaaacggtcgaacgcttctcccaggacacgtgacgcttcaagcgactttttcaacacgtcggtatcccgcgattcgatacgttcgatactccgcaggacttcgctgtttaatttttctataaatgcaatcataatccgtcttgttactttcgcgtataaagttagcgaatcgaaaaaccggcggattacgatttttatctttctcttcgtttttttatcacgaggccgattttaatgtcagatccggccttcctggcggatggaagtgggattgctccccatattccgcttgcaaaagtccgtaaagtgggattgggcggagaaaccgcacatgtaggctatttcctgcaacgtgtagtgtgtcgtccgcagcaactccccgatacgttcgatacggcgctgacgtaaccacgaggaggccgagcagccgaaaacccgctggaaacgccggcggaaggtaatcgtgctggaatacccgcaaaccccggcgagttccgtgacgttatccgaggcaagataattcgatttgacacgggagatgaactcgtaatcgtcccccaggtgcaacagctcctcgaactccccgacatcggcgggagtgagatgttcataagaggcgtcgagcattttcagcatgacagcagcgttacattcaacgggcatacccaatgtcttacgggcttcacgcaggtaattcttaaaccgcagccgcagcgtgtcgtgatgcgggtaggaacactggaacagaatggtgcagaccgtccgcagttcatcgacacaacagtagccgaaataccacgttacaagacgctcgacgtaatggacggcatgaaactcctccgaaagcatcagaagaagcaggaacggggtgaaatcctggtattcccccgttatgggacggggtgcttcgtcaagcaaggaggcaatgtcccgcatcagaagagaatctcccgagtacgcttttatttgttcggaactgcgggcataatcccggtaacgcgatatgaccgccgacaaagcattgaacttcacggcgtgaacgccttctataaaggaagggcgaagactgttgtaaatggataagtcggtttgcataagtcatttctataaaacggagccgcatccccttgttgccaaagctccgcaagtcgttacttatgaaccgcttggaacacggtacgaatcctaattacaaatatatcgcatccgacaatccggaacaaatatcagcaggcaaaaatgaaaataaacctcgttatttttgatttttacctgcaataatattatatttgcaaacaaataagagttgtttgacagcatgagaaatatagtgtatcaaagcactttaccaatttcttatccgttgcctattctcatgcgagtttcttttaatctatttgtagtcaattaaataccttcagactacatcaaatatacgaaaaaagagagagaaatggttatttattttcttaaaaattattcgagtgtgatatgttttacgctaatctgctgtttcaggaaagtagaggccgattctgaaaacttttcttccgcttcggtcgtgtaaaactggcagttgccattcttggtacatttggcatccatttcgggatgtcttttcagatagtctttcaggctttctgcaacatactctccttgtgcaattacactgatatgatccgggatgtattgccggattttaggtaggagtatggggaaatgggtacatccgaggatgacagtatctatttgaggatcctttgacagtaattggtcgatgtacttccggataaaatagtctgctccttcgtcttgtgattcgttattctcaactaaggatacccacatcggacatgctgtcccgctaacctgaatttcaggaaacagtttatgtatttctaatggatacgattcggatttgatggtgcctgctgttgccagtacaccgatatgctgattcttgctaatctctccgatgcattctacagtggggcggatgactccgagcacacggcgggcaggatcgatttggggtaaatcattcatctgaatgctgcgcaaagctttggcggaagcagtattgcaagctaatataaccagatgacatcccatatcaaacagtttgttgacggcttgccgggtaaattcgtatacgacttcgaaagaacgtgtcccatagggggcacgtgcattatctcccaaatagatataatcatattccggtaatacttctctaatcttgtctaagatggtcagacctccgtatccggagtcgaatactccgataggtccgggcgtatgggatagatgttgcttcatgacacacttgatttatatacgcaaatgtacaccaaaaaaagggaaagagaaagaagatgatccttctttctctttcccttttggtatttctttattcttggtcagctcttatttgataccaagatttgcttttaccttgctagtcaagttgatgctctgtgattcgtttacataaggaatcgaagttcttgccaggtcgaagatatagatcaccccttcagcagcacctactgctttgatagcattgtccaacttctggtagataggagccattgcatcattttgagctttctgcatttgttgttgagcatcctgttggaattgctcttgtctctgcatcatatcttgcaactctttctgtcttctttcagcgatgttaggaggaagagaatccttagcgatagcttgttggaattcctgatatttcttgttgaattcttcctgcgttctctgtagttcggcagtaagttgtttttctaaagtctgaatatcattttgagctttggtgaattccggcatcacagtgatgatttcctgtgcattaatgtggccgaatttcaggttctgtgcaaatacacccattgggagtgcaagcaacattacaagtgcaattttttttagcatagttctataatttatttgaatgatttttagttatttccagctgcaaatgtatgaaattaatttgaatatcctaattttcttaggatttcatcactaatatctatgcgtggatttgcaaatattatacctgtagcagaggctctgtcaattaccatatcatatccatgttgctgtgatatagctttcactgcttcataaatatcatcctgaatcggagtaatcaacttgtctctcatcttggctaattcgccttccggaccgaagtagttacgcttcagctcggctgcttctttttccttcgctacgattgcatcttctgtctttgttttttgtgcggcagaaaaagtggaagattttgcctggtaatcctggaacatcttctgtgcttctttagccagagcttctacttcactctggtatttcttcgtagcttcttgcatttgctcgttagcgctttgagctgccggaatattcttcataatatattccgtatcgatcagtgcaaatttctgtgcatttgctgccatgctgacagcaaatagcatcatgattaatagaacagactttctcataacgtttagtttttgatgatacattagaattcttgtcctaagataaagtggaactggcttcctccatattgtttagaaccaaatactttgtcgaaaccgtaaccccagtcaatacccatcataccaatcatcggaaggaagatacgaacaccgacaccggcagaacgtttcaactcgaatggattgaatttcttgatatcatgccatgcgttacctgcttcaaggaaacctaacacataaatgttagtacttgtttccagcatcaacggatatctcaattcgataccgagacgtgcataggcataaccttcagaaccgtatggtgttaatgagctgttttcgtaaccacgcaaagcgatactttcagttgcataagttgaataaccggtcataccgtcaccacctacgtcgaatgtaccgaacggagatttcttgtattggttatagtgacctaacagaccgaattccgtacgtgtcattaataccagacatttaggatgagcaaccggatccatcagcggagtatatgttttgcctttgaatttccatttgtggtattctatccatttatgaagtttattcatgttgtcctgggtaatgctacctgtttcagggttgctgtaatatcccttatagtctttaccgtccatcaacgagtaaggcggtgtgaactgaactgacagtgagaaatctgaacccgaacgagggaagattgggttgtcaatagagttacgagccaaagtcaatgaaatgctaaggtcattacatttaccgttggtgaccgggaagtattgccagtcgctcaagttataacgttggtaagctaattctgcagaaagagtgaaatagtcatccggccatttcagacgtttaccccaacctacggaaagtccccacatcttgatagacttatcagggtcataatagttttcgtagttgttatagttaccatagttgtacataccataaccaccgtagccactatacatactgttgtagtagttgttgaagtagctggagttgtagtaacggctactgatatctgtctgtacagaaaagaatgccgatacagagaatgaattcggacgtttgccgccaaaccatggatcgaagaatgaaatactgtatgattggtagtatttagcgttcgtctgtccgctgatagtcaatgtctgaccatcaccttgaggaagtataccacggtagttttcacccgggtgcaacaagttggctacagagaagttggtaaacttcaagctcaacttaccgataatacccgtctgtccccaacctgcagagaattccacctggtcgttagctttggaagtcaaaggcaaacctatgtcaacagttccgttcatcggatccggttgaatatctggttgcagtttttccgggtcaaagtgtcccatctgctgaatttcacgcaaagaacgcatcaagtcttctttgctgaacaattgtcccggacgaatacgaagttcacggcgaacgacgttttcatacaaacggtcattaccactgatcttgatcttattgatagtagcctgacggccttcatagattctcatttcgaggtcgatagagtcgccaacgatatttacttctaccgggtcaaggttatagaacaggtaaccgttgttgtagtataagttaccgatagcgtcatcatctgtagaaacacgttcgttcaataacttctggttgtatacgtcacctttcttcatgcggagcaggaagttcaactgttctgacggatagagagtgttacctacccatgtaacgttacgcagataatatttttgtccctcgtctatattcaaataaacgtttacagtcttttcgtcatactgtgaaacgctgtcttttacaatcattgcatcacggtatcccaactcattatatttgtcgataatcagttgcttgtctgcctcgaagttctctggcacgaatttcttggtgcggaacaggttacgaagtttacctttctcattggttttcttcataactttcttcagcttggaagtcttgatcgcatgattaccaacgatttggatttcgtgtactttgattttttctttcttgtcgatatcaatgtcgacgatcacctgattttcgctggatggatcgtctttctgcgagatgattacttctgcatttttgaatcccttatcgtcgaagtaacgtttgattaatgtcttggcacggtctacggtattcggagtaatctgcataccttttaccattcccagcttgctttcaagatcggtacgttccgacttcttcacaccatgatagcgtacatctgcgatacgtgggcgttgtgtcagactgatttttaaccagattttgtcaccttcaattttctcggctgtgatttgtacatttgagaacaagccatgacgccaataacgtttgattgctccagtaatttcgtcacccggcacagtaattgtctgtcctaccgatagtccggatagtccaatcaatacatagtcttcataattctttacgccttcgactttaatatctgctatctcatactttttgggtgttccggagtataagatgacaggtttcgagtcttcatcagtgttagcattttgcgcaatgcctgttgtcgcaaagcagcacaggcagacaaacgttatgaatataaaggaaatacgataatgcatttatgttataatttgatgtttcgagttatattagctgatctgttcactggttttgccgaatcggcgttccctttgttgatattcccaaatggccttgtagagttcttctttatcgaagtcgggccaaaaggtgtcacaaaaataaagctccgaataagcgcattgccataggaggtaattgcttagccggatttctcctcccgtgcggatcagtagatccggatcgggcataaatttagtatccagatgagatgagatacattcatccgttatctgttcgggagacatttctcctgcttttatcagtgttgctatttgccgtacagcttcggttatttcccaacgggatgagtaactaagagctaataccatatacataccactatttttggatgtacgttctatgcatgatgccaaacttttctggacttcaacaggtaactttttgaaatcaccgattacattgaagcgaatattgtttttcatcaatgtctcttcttcaatagattctagcaatagattcatcagagccgcaatctcatcttgcggccgattccagttctcggttgaaaaggtgtacagtgtcaggtacttgattcccaaacgggcggcatcttcggtaatattctgtaccgtttctgcgccagcacggtgaccgtaagtacgttcttcccctcgttgttttgcccatcgtccgttcccatccataatgatggccacgtgttgtggtatccgagttttgtctatttgttctatataggacatctttttattttaaacgtatacgtttttttattgaccggcatattccggattcagatcaaaccatagctgattaagacgagcacgccaaacttctgaatcatgactgtaaggccccctgactttagattcggtagctcgagtttcttcagctttttctacttcttcagtgaaagtaatgttttgttctttaccgaataaaacataaataaacttattctctgtatcttgcactatagaatagttctttcttcctctgaattctggtttttctatactcggagtaaaaccagattcattccagtcctgatgggggaaggagaattttttatttgctttttgccaggctattccttcgttttgagaaacatagattgattcgaactcgtttccaaacacataaaaaagttcgttataataaataacggttggattatcaaatgccggacagtaagctgttgtagattttgttcccaacttagcccaaacattaccgtcatatccccatgcaatagtaataggaactttcttattattaatatcgatctctattgcaggttcatgctttcctacgatgatattacgatagtaactacttcctttactaaaggttgtgtaagaaatattgtccacagggaattccttgtccgcttcttcgatctttttttctgaatccgctgcacctagctctgattctaatattgaatagatatattgttttccgtcttcagttttgatataggttattttagtatcagtatctacaggtatttttgagataaatgtttttacattgccggagaatttatcagaaattgtccaagcaacaccatctgttgattcatataccttattattagcggtcgctaatatgattccattcaaaggaagtatagaattaggtagtgtactggtaagatcacccgtagtattggtccctgccgctgtccaatttgaatagttgctgttttggtatactttcaaattttttccttctactacggaataggtaaggattttattgttgaattcaatcgttttttgttctccaatgatctcatcctgcattttaccaacgtgattccatctcaacgaatcgggatcatgctgatgcacatttaccttaatagtatattccttagtttgattaggagatattcccgctaaggcttctgtcgaccatacctttatagtaagtggctcccgaagatcgatagaatcattgatgtttatgacagaatcgttaccgcttttgtctttcattgttacgacgcctgatgccgtagttaatgttttgattaaaatcttgtcaatgatggtatcggcatgaacaggaagagagtcctcgttataaatttcacgtgataattgatcaatagtgaatttataactcccaaggcctgctgtgtcaagtgcaaacgcatggatagttgcatccgggctatattcgatgttattatcgtcatcaagacatgacgttataacaaatgacaccatgaaaaaactcgcaatgaatgataaaaactttattttcatttgaaagattgtgtttatttacaagttgcaaaaatagaaacattttttccgataatgaacattacaggtaagttttatataaaattatagataataacactgtttttatcgacgtaaaaccccctgaatagaactatcttagctatatccgatgaacataatgccaaaattgtctttcgaagtgttcttctatcgagtaactaaaattatcgttcatttggggtgcttgaacaccggaatgtagtctgctggggcacttctcgatatacgcctcatcccatagctcgtcattaatgaacgattgcagcaattgactgcctccttctaccagtaaggattgtattttccgttgatacagtacttccataatctgctccagtgggttatgattgaagtcgatggagatatatgtgatgttggttcttgctggctgtttcttttcagtaaagactaatgttggcacattcccatcgaatatttgtaaatcattcggaagagataatgtgcggtctaatacgacacgtattggattatgtccataccagttgcgtaccgttagcgacggattatccaataaagctgttcgcctgcctaccataatcgcatccgcctccgctctttttttatgtactagcattgaagtgagaggagaggagagtatcaaaggcattccacttgtacgttctatatcaataaaccgatcggctgactctgcccattttaatgtaatataaggccgatgaagtgtattgaaagtaataaaacgacgaatcagtgattgacattcttcctctaatatgccgactgtaacttctcgtccggcatcccgtagtttttgaatcccccgtccggctacttcagaaaaggggtcctggcatccgataacaatgcgtggaatctgtttctctataatcagatccgcacaaggaggtgttttcccgtagtgggagcaaggttccagactgacataaatcgtagaatgtttcaataaagactcatctttgacagaacggattgcattgacttccgcatgtgcctctccgcagcgaatgtgataaccttcgccgataatacgtccgttacatacgataacagcccctaccgtcgggtttggaggcacattgcataacccgttctttgcaagctcaatgcaacgcctcatgtatttttcttcttccattttggtgctcttcgccatattattcttacttttgcactccgaaattgtgaaaatatgaatcgtatcaccgcttacattcgccagtctttgcaggaaagctatccgcaggaagagataaaagctctttcaatgctgatttgttgcgacatgttaggcttagatgcgcttgatatttacatgggcaaagatataattttatccgaatgcaaacagcgtgaattagaaaacattatattccgtttacagaaaaatgaaccgatacagtacattcgcggttttgcagagtttagtggaaggaattttaaggttgcttccggcgtgttaatccctcgaccggagaccgcagaactcgtagagctaatagtaaaggagaatccgaatgcccgtcatctgttagatataggtacaggaagtggatgcattgcgatctctctggataaaaaacttccggatgtagacgtagaggcatgggatatttcggaagaagcgttggctattgcccgtaaaaacaatgaagatttggaagccggggtgagatttctgcaaagagatgtattgtctgatgactgggaaaaggtgccgtcttttgatgtgatcgtcagtaatccgccttatgtgactgaaacggaaaagaatgaaatggacgctaatgtccttgattgggaaccagggttggcattgttcgttcctgacgaggatcctttacggttttataatcgtatagcctgtctgggaagtgaattgctattgccgggcggaaaactttattttgaaatcaaccaggcttatggccgggaaacagcacacatacttgaaatgaaccaatatcgtgatgttcgtgttataaaagacatatttggaaaagatagaatagttacagctaaccgatgagtgcacaattaactgatgaagaggctttaaatcgcgtagcctcttactgctccactgccgagcattgccgggcagaaataaatgagaagttacaacgttggggaattgcctatgataccattgcgcgtattcttgaccgactggaatcagagaagttcattgatgatgaacgtttctgcagggcttttgtgaatgacaagttccgctttgccaagtgggggaaaatgaaaatagcccaggggctttacatgaagaagatcccttctgatgtggcatggcgttatctgaatgaaattgatgaagaagaatacctttctattctgcgtgacctgctggcttccaaacggaaaagtattcatgcggcagacgattatgaattgaatggaaagctgatgcgatttgccatgagtcgtggatttgaactgaaagatattaagcgttgtatcgacattcccgatgaagaggaacaaattgactgaaaaaataaacggattcttctttttattctcgttcaatttctgtacttttgcggcaaataattaatagttagtttagttatgaaaaacttagagagactatttgcggagaaactgttgaagattaaagctattaaacttcaacccgctaacccttttacatgggcttctggatggaaatcccccttttactgtgacaaccgtaaaactctgtcctatccttctcttcgtaattttgtgaagattgaaattacacgtctgatattagaacgattcggacaggtggatgcgattgctggtgtggctacaggcgctattccgcagggagctttggtggctgatgcattgaatttgccgttcgtgtatgttcgttctacccccaaagatcatggattagaaaacctgattgaaggtgaacttcgtccgggtatgaaagtcgtagtcgtagaggacttgatttctactggtggtagtagtttgaaggctgttgaagcaattcgtcgcgatggttgtgaagtgatcggtatggttgcagcgtatacatacggattcccggtagctgaagaggcgttcaaaaatgcgaaggtgactttggtaacgttgaccaattatgaagccgtgcttgatgttgctcttcgtacaggttatatcgaagaagaagacatacagacattgaacgaatggcgtaaagaccctgctcattgggatgctggaaaataagattcattttttgatcaaacatatttggtaaaaagaactgttcgggcaatatttggccggattgttctttttttgttttatactaatagaaaattatgagtaattttgagagtagtgtcaaggtaataccttacagccaggagcgcgtatataataaactttcagatttaagtaatctggaagcagtcaaagaccgtttgccaaaagataaggtgcaggatttgagttttgattcggacacgttgagttttagtgtctctcctatcggaaagttgactttgcaaattgtagagcgtgatccttgtaaatgtataaagttggcaacaactaactctcctcttccttttaatatgtggattcaattggttgaaactgcagaagaagagtgcaaagtgaaggtaactatcggaatggatcttaatccatttatgaaagcaatggtacagaaacctctccaggaaggtttggagaagatggttgatatgctggcagttattggatattaaacttttttttatggcacagaaactttgggagaagtccgtacaggtaaataaggatatcgaacgtttcacggtaggtcgtgatcgtgagatggatctttatttggccaagcatgatgtgcttggttctatggctcatattacgatgcttgaaagcattgggttgttgacaaaagaagaactggaccagttgctggtggaattgaagagtatttatgcctcggccgaaaaaggcgaatttgtgatagaagacggggtggaagatgtacattcacaggtagaattgatgttgacccgtcgtttgggagatatcggaaagaaaatacatagtggtcgttccagaaatgatcaggttctgttggacttgaaactttttacccgtacgcaaataaaagaggttgccgaagcggtagaacaactatttcatgtcttgatccgtcagagcgaacggtataaaaacgttttgatgccgggatatacacacctgcagattgcaatgccttcttcttttggcttgtggtttggtgcctacgccgagagtcttatggacgatatgctgtttttgcaggcagcatttaaaatgtgcaatcgtaatccattaggttcagcagccggatatggttcgtcttttcctttgaaccgtaccatgacgactgacttattaggttttgattcaatgaattacaatgttgtatatgctcaaatggggcgtggaaagatggaacgcaatgttgcttttgcattggctacgattgccgggacgatttccaaattagcttttgacgcctgtatgtttaacagtcaaaacttcggtttcgttaagttgcctgatgactgtaccacggggtccagcattatgcctcataagaagaatcccgatgtctttgaactgacacgtgctaaatgtaataaactgcaatcgcttccccaacagatcatgatgattgcgaataatttgccttctggctatttccgtgatttgcagattatcaaagaagttttccttcctgcttttcaggaactgaaagactgtttgcagatgacaacctatatcatgaatgaaataaaggtaaatgaacatattcttgatgatgacaaatacctccttatttttagcgtggaagaggtaaatcgtttggcacgtgaaggtatgcctttccgtgatgcatataagaaggttggtttggatattgaagcaggtaaattctcgcatactaaagaagtacaccatactcatgaaggtagtatcggcaacctctgtaatgcagaaatctccgcattgatgcagcaagtgattgatggattcaacttttgtggaatggagaaagcggagaaagcactgcttggaagataaaatagactttcggaggatagttttttaaactttcctccgaaaagatttggcagaaacaagtaaactacttatctttgcacccgttgaaaaaacgcggaaatagctcagttggtagagcataaccttgccaaggttagggtcgcgagttcgagtctcgttttccgctctttctttgaaaggatgctcgaatggtggaatggtagacacgaaggacttaaaatcctttggccattgcggctgtgcgggttcaagtcccgcttcgagtacgagtattctttataggctttatgaatcattgattcatgaagccttttttatttttatgggtgtgtaatatacatttgttttgtttgagggagctttgtagtaatggctacttgaaaaaaaatcaaaaaacagtaataatatttttttattgtgttattaatcttttattttgctttcagattataagtttataatgaattattatattaccgcttctttaaccttatacatggtacatttaatttaaccgttaacgctgaaaaatactagagagatggaaaataacgacaagcagattgaattaaagtttcagaggttttttactgtgaattttccgaaagtaaagaactttgctcaaatgctgcttaaatctgaaagtgatgcagaagatgtggctcaagatgttttctgtaagctttggatgcagccggagttatggctggataatgataaagaactagataattacattttcataatgactagaaatatagttctgaacatctttaaacatcaacaggtagagcaagaatatcagacggaggttatagaaaaaacttttctttatgaattgacagaaaaggaagagatattgaatagtgtgtattataaggagatgctcttaattattcagttgacactggagaagatgccgaagcgtcgtcggttgatattcgaactaagtcgtttcaggggattaagtcataaagaaatagctgataaactcgatgtttctatccgaacaatagagcatcaggtttatttggcattgatcgaattaaagaaggtactcctcttttttatttttttctctgatatttttaagtagtatgtatgtagtagttgtatttagtgtataaagcccaaaaagaaagaaaaagattcatgaaagattatattcaacaactcatagaattgttcggccataataactattcagccgatacgcataagaaagtgcaacagtggttggctgatgaggagcatgttgatgaaaagagtgaggctcttcgtgagctttggaaacaagcaggagaacagaaagtgcctgatggcatgcaacaatcaatacaacgaatgcggcagaatctgggaatgcagtctatcacttcacgtagaaattaccagttgcttatatggagagctgcagctattttattgttagcagtctcatctgtttctatttatttgatgttggaaaaggaacggccggaaaaagatttagttgaatgctatataccgacagcggaaattcgtgaacttacattaccggatggtacatatgtcatgttgaattcgaagagtatactactatatccggaaaaatttacaggagagactagaagtgtatatttgattggtgaggccaactttaaagtgaaaccggataagaagcatcctttcattgtaaaggccaatgattatcaagttactgctttaggtactgaatttaatgtaaatgcttatccggaaaatagcgaactgatggctactttgctggaaggtagtgtgaaagttgaattcaataacttgctgtccaatattattttaaagcctaatgaacagttggtgtatgacaaacatacgaaagcgcacaatctgcggatgcctgagatagatgatgtgacggcatggcaacgtggggaactggtttttagtaatatgcatctggaggatatttttacaagtcttgaacgcaaatttccttatgcttttgtatatagccttcatagcttgaaaaagaatacatatagtttccgcttctccaaacaggcgaatttggaagaagttatgaagattatatcgcaagttgttggaaatgtaaactatgttatcaagggaaataagtgttatgtaactagtaaagaataaatatattgtagaaccttttaaatttaatacgtaatgcaaaaaaatacccggaaggaatggccgttcctcccggatatgaaatcaatctcttttaatattagcgtaatattgacgctattctgaatgatcctagaataataaccaattaactaatactaaagatgctacaaatctacgaaaaaatagcagaaaaaatagctcataagcgggtctttctcacttttttaagtcttattcttatacagactttcgctttggctcaaaatgatagtaaaataactatccaacaaaagaatattactgtcattgatgccttaaagactgtggaaaaacagtctaaaatgtctataaattatagtgattccgaattgacaggaaaagtaatagcccagttaaatttgcagaacgcatccctcgaaaccgcacttgataccatcttaaaagggacgggcttttcattccaaatacaaggtaactacattataatagctgaaaagaagcctgtagttgcacaaatccttaaaaatatcaaaggaaaggttactgatgagagcggtgaaccgttgattggagtaaatatatctgtggatggtagttctacaggtacgattaccgatttcgatggtaactttacgatcaaggcagcagagaaatctattctcaaagtatcttatatcggatatgctgcacagataattcctgtttccaagaaagatttctatccggttgtaatgaagcaggatacagaagtgctcgatgaagttgttgtaacggcattgggtatcaaacgtgcagaaaaggcgttgtcttacaatgtacaacaagtcaagggagatgcactgactacggtaaaagatgctaacttcgtaaactcgctgaacggtaagatagccggagtgagtattaacaaaagtgctagtggagttggtggtgcgacacgtgttgtaatgcgtggtgcaaaatctatcgaaggtgataacaatgctttgtatgtggtggacggtattcctttgttcaataccaatatgggaaataccgacagtggtattatgggtgaaggtaaggccggaacagaaggaatcgccgacttcaatcccgaagatattgaaagtctttctgttttgagtggtccttcggctgctgcgttgtatggtagtagtgccgctaacggtgtaattttgattaccactaaaaaaggaaaagaaggaaaactttcagtgcagttctcttcttcttcagagttcagcaaagcttatatgactcctgagtttcaaaatacgtatggtaacaaaaaagatatgtatgaaagctggggtgagaaactgttgactcctacaagttatgatcctaagaaggatttctttaataccggaacaaactttattaattcggttacgttgaccaccggtacgaaatcgaatcagacttttgcttctgtttcttctaccaattccaaaggtattgtgcctaataatgaatatgaacgtttgaatttcacaatccgtaatacggcaactttccttaatgataaattacaactcgatttaggtgcgtcgtatgtgaaacagaaagacaagaatatggtatcgcaaggacaatattggaatccggtgatggccgcctatttgttccctcgtggtgaagactttgatggaattaagtcattcgaacatttcgatgaaagtcgccaacttccggttcagtattggccggtggcagatccggtatatgcttcacagaacccttactggactgcttatcgcaatgtagctacgaatgaaaagagtcgttatatgtttaacgtagggttgacttataatattaccgattggttgaatgcgacagcccgtttcagaatggatgacacacatgtattgtttgaacgcaagatttacgcttcatccgacgataaatttgcggaaggaaagaaaggactgtatggatacaataactatgaagaccgtcaggaatatgccgactttatgttgaacgtaaataaacatatagctgatttcagtatttctgccaatgcgggttggaactattctaactattgggcattggagagaggatacaaagggacattattgggagtgcccaataaatttgcggcttctaatatcgatccggctaatggtcgtatctcagaaaagggtggtgatagtcgtgtacgtaatcatgctgtttttgccaatttggaacttggttggaagagtatgctttatttgacactgaccggacgtaatgactggaattcacgtttggtgaataccgatgaagaatctttcttctatccctcaatcggtctatccgggattatttccgagatggtcaaattgcccgaatttatctcttacctgaaagttcgcggttcgtatacggaagtcggtgcgcctgtatcccgttcgggactgactccgggtacggtaactacccctattgtgggtggtgcattagatcctaccggtatctatccgtttactgatttcaaggcagagcgtacaaagtcatacgaatttggattaagtctgaagttgtggaataaattaagtgcggaggtaacctactatcattctaatacatacaatcagactttcttgggtgatcttccggaatttaccggatacaagcagatttatttgcaggccggtaatgtggaaaatcgtggttgggaggcttcattaagctattccgatcagtttaagttcggattaggaatctcttcaacattgacattctctcgtaatataaacgagattaaggagatggttgaaaactatcatacggatttgatggatgaaccgattaatattccggaggttttgaaggatggtggtcgtgtcatcttgaaagaaggcggaagtatccacgatatttatgccaacaccttcttgaagaaagaccacttgggatatgttgaggtaaagagcgacggaacctttggaatggaaaagggggaacccgtttatttgggaaaaacttctcctgatttcaatatgggatggagtaatatgttgacatacaaaggctttgggctcggattccagatcaacggacgttttggaggcgtggtgacctcttctacagaggcattgcttgatcgtttcggtgtatccaaacgttcggctgaggctcgtgaagcgggaggcgtattgttgaagggacaaggtctggtagatgcgaagtcttattatcagatgacaggtacgggaaattatgaaacttccggttactatgtatacagtgccactaatattcgtttgcaagaacttacctttagctatactatgcctaataagtggtttggtaacgtgttgaaagatgttacggtttcgtttatagccaacaatccttggatgttgtattgcgaagctccgttcgatccggaactgactccttccactagtacttacggacaaggtaatgattattttatgcaaccgagtgttcgtagctttggcttcggtattaaatttaaattataatacaccttctttattatgagaaaaatgaatcattttaaactattagcggtgatatgcgcaatggcgctatttgcctcatgcaattttgaagaaatcaataccaaccaatttgaaatgagcgacggagaaggtgcgatggatggttttgaagtcggagggctgattacagctatgcaacggacagtgattcccgtaggcacactggctgatgatacaggtgttatcaatgaatatcaaatagcttatcatctatcggccgataattggagtggattttttggcgagaacaacagtaacggttggaacgcaggtagtaacaatactacttattatttgttggacaattggataaaagcgacctatacgcagtcttataccaatgctcttgatccttggaagaaattgaaaatagcgtccgagaaaaatggtacgcccgaagtctttgctttggctcaaattctgaagatttccgcttggcacaagacacttgaaagtttcggcccgatgccttattctcatgcggcggacgctacaatgaacattccgttcgattcggagaaagaggtgtatacggcgatgtttgaagaattgactgcagccattgaagaattaacagaaaaggcggaaaatggggtgaatgtaatgggcgcttatgatgcggtatatgccggagatgctaccaaatgggtgaaatatggcaattcgctgatgcttcgtttggctatgcgtgtccgcttcgctgatgcggaactggcgaaaaagtatgctactcaagcagtaaatcattctatcggcgtgatgacggctaaggatgatgcggctcaaatgagtcaaggggcaggtatgacttttcgcaacaacattgaatggctggcaggcaactataatgaagctcgtatgggttcttccatcttttcttatctgatgggatatgaagacccgcgtttaagcgtttattttttgccgatggatggtaatgcctcttatggtgttgaggctttcgatggaaaaacatatcaagcggtgccggcagggcatgccaatgcgcagaatgatatctataaatcttgctcaaagcccaatattcaaagtggaactcctacatattggctgcgtgcatcggaagtttattttttgcgtgcggaagcagctttagtgtgggaaggtttcggcagtgcggattcatggtataaacagggcattgatatgtcttttcaggagaatggtgtgactgatcctgtagacgattatatgaattccaatttgtcacctcgggcatatgttctttcccataatcagtatgggcaaacactttctgctccgtgtgagactactgtcaagtttgaagggacaactgagcagaagttggaaaaaattatgattcagaagtggattgctttgtttcctaacggacaggaagcgtggacggaatggagaagaaccggttatccgaagttgaatgtcattaagactttgaaaggagcagtgcaaggcgcaactcttgagggcggtattcgccgtatgatttatcccaccagtttttctcagactaacgagggaaaggctatttatgaagcagccttgaagttgttcaataacggtgcaggtggcgaagataagtcttctacccgtttgtggtgggattgtaagagataacctacatgtatcattttaatacagatgaagaatatgaaatcattaagaaaattgttatatattattccattgacaggcatgatggtaacttcttgcatggatgtggagaatattgagatagaccatataggcgggtatgccacaatgaacaatgcggagagtgaggcatattatgccaatctgcgcgcctataaggcgactgcttggaattacaatcgtcccgtagctttcggatggtattccaattgggcgcctgctggagcttatcgaagaggatatctctctgctatgcccgatagtatggattttgtttctatgtggagtggcgctccaggacgttatgaaatcactccggagcagaaggcagataaagagtttgtgcaaaaggtgaaaggaacgaaactgttgcaggtaagtctgctttcttatcttggtaagggcgcgacaccaaattcggtatacctcgaagtggaaaaacaagcggaggaagaaggctggtcggcggctcaattggaaacagcgaagaaacaagcccgttggaaatattggggatttgaaggtcagtttgaaagtgaaaaccattatgcatgtctggcgaagtttgccaaagctctgtgcgattctttgtatgcaaacgaatgggacggttatgatgtagactgggaaatcggtagtggtgtgtttgatatggatggcacattgagtcagaataagcatttgattcatttggttaaagagatgaacaattacattggtccgaaaagcgatccggaaggtaaaggacataaaatgatctgtattgatggaaatatttatgggcttacccgtgaattggatgagtatgtcgattattggattatacaaagttatggtagttccaatcccggttttgatggttatggcgttgatcctaaaaaaataatctgcacagagaactttgaaaagtatgccactaatggaggtcaattgctgaagcaggctgctgctatgccgcaagaaggttataaaggtggagtaggagcttatcgcttcgataatgattatgacaatacgccaaattataaatggatgcgtcaggctattcaaatcaatcagcgggttttcaatgaatggaaagcgaaacaaaacgaagcggaaaataaaccgcagaaataagtggacttataaaattctaaaacagtaaaaagatgatgaataaacatatattctattatttgatggtaggtagtatggcgttattgttgggcgcttgcaacgacagcatgaatgacctgctggagcctaaggtttatttcgaaagcaaggaatataatttctcggtggaagatgaaatggatgtaatgacatttgatctggtttcaagactctcgtcagcaacttcctctcaggtagacgtatcatatagtgtagccgaaccaagtgtagtagacgaatacaatgcaaagtatggcacaaattatgagatgcttgatgtttcgcaggtaaagctaagcagtacgacatcttctatttcgagtggaaaattgtatgcggataatatagaagtcgaactttccgggttagaagccttgaaagccgggaactcatatgttttgcctatgcgggtgcattcgtcttcggtgtcgactctttccggaacaaacattgcatatttctttttctccaaaccgttgaaaattaccaaagctggtaatttcagtaaccactatatttctgtgaagttccctgtcggtactttcttctcgtcattcacttacgaagcattgattaatgtggattatttcctcgataataatacgattatgggaaccgaaggtgtgatgattctccgtatcggtgatgcaggaggaggaattactcctaaagattatttggaagtggccggaggacagaactaccgtgtaacgaaaccgttgttaacaaatcgttggtatcatgtagcgttgacttatgatcaaccgacaggaaaaacaggtatttatgtaaatggtgagaaatgggctggttcagattggggtattgacggttttgatccgaattcggacatgggtttttatattggtagaatctatggttttaaatggggtgaacgtccattccatggtaaaatgagtgaagtccgtgtttggagtgtagcccgtacggaaaatcaacttaagcagaatatgctgggtgttgaccctgcttcagaaggcttggcactttattataaactagacggatcagagactcaggaaggtggagttatcaaagatgccacagggcgtataaacggtactacaaatggaattactattaagacgttggatgctccgatagctatcaattaatggaacacacaaatttgtgagagtttttgctctttgcatttttgaatatgagtgaaagcctgcttactgaaaagataatattcttttggtaagcaggtttcttttatttatgtttgttttatgaagaagttactatttatcctgtttatatcttttccatctaaatgtttttgaagcgtggtgaagaacgggaagtgaagtttattttgtccgaagaggatttctcgcttgtcgatcggaatttaaagaggattgtggagccgggaacttttcagataatgattggtgctgcttccgatgacataagattacagacgaaagtagctataaaataggagatgccatctttgactgtttgatatgttttctaaatacattcagtgtgtcggaaattccgacacactgaatgtatttgtagcttgcacctatttttattgtcaaacagttagtataacattcaaataaatgaatatcaatgctctcttgataataacctctgataataggctgataatgaaatatagtctcgatgctatcatttcattccacttggttcgcgctttataattcgatttttagatttgaatgatcatagactatgggaatactttccccattaacagacacagataccgggcattgtaaacttctgatataggctttgactttggtggagccatcaatccatagctgcatgcgtctattttcttctttctgaataataaatagttttgccagcgaggagaaataagaggtagttcctctttttaatgaactgccataaccaataaaatactctttagcatctgccggagcgctcttttccggatatgtaactataaacatataagcatctgtagaccagccatcggcttcaatccatgaattgctatgcattaatcgtccgtctgctaactgattaatataaatatctgtaatcttacccttattgcggatgcgtaaaccaatccagtttttaccttcacgtttctcaatctcaggaagctctttttcatcgggagtctcttttaaaataatagcagtcacacctttcactctattgacttcgtcaggcaagtgaaaagaataataactatctttacttttcaaatcttcagtcggtacttctattacttcccaatacaaattgtccggataatcatgcacaaaattagatcgtgccaacgtgcgaggatataatggacggactattactgaagaatttccatttgtaatgtttagatctgtcccttttttctcagttattcctcccggatgccacaaccattcaaaatgaccggtttcataggtttttaaatcatcaatgatatagatgacgttgtctatccacaaaaagtgacggaagttgcggctaaactggtccgaataaggacctgtaccatttgccaacacatattttatatttccggcatccaacagataatgcagatatcctcttaaggtagaaccataatattgctgttctcgtctttgccctttgccattgaataatacgacattatgtgcctcgctttgaaagaagtagttgcggtattcgggattcgcataccaacatcgtcctccatctttgataatatcctctcctttatgaaagactatgaatgaattggcatcggcatgagaatgattccaggtatatccggacttgacggctaacattgtggcatctttctcccaagagttgcgcatggttgcccaaccgaagtctttgaataattgtgatttctttagtttaggaaccttgggtgctttactcaaatcgggagtatagagaaatcctatcgggcggtcgataaaatatccatcacggtgttgcccttgctctatctgattcatataccaaagcatatcatcattttgaatccccattgcatataataacatcagactactttcggcagccgtgtttttatgactgtccccgaagtttatattataaagcatacctgtacgtggataacagatatgtacaaaaaaatctgataacttctccagttggggtatctctattgctttatcttccttgtgagtattcatccaagctaagcggaataataaagcctcttgaatcccgtagtttgcatagttcagacattcatacattccaccggtctcatcaaaggtctttggcttttgatgaagcacatctcctgcaaactcaaaccattcgggaaggacttcgttgataatctttacagcatctcttgcttcttccaattcattctgtaagcttagtgcaagtagaccacccatacacgtacaagaagtccaccagttgtgccccattgagtttagtgaatgaatacgtgttggctccaagatccagtcacctaatagcgggtccattgccagacgttttaatccgtgagctatttttcttctttcagattgagaaagttcttgatagatggcgtcataagctattgctgcataaaaagctttatgtgcaatctcaaggtcggcgttccaggctggggtacgagccatcatttcttgattgccccaagtttcgtcctcagtgacatccagcaaaatctcttttattttatcagcatacttcttttcatccgtcattagaaatgagagtgctaaatagtctatcttattcaattgagttttctgcaataggttatcggcagttttcctgattgaattccaagcttcagacattcgtgtatcctgtctgacacttatttttgcctgctcaattcgttgaggggtataaagtaaggctggatgctttattttttctgcatggataaaaagtaaatataaagctgctgaaagacataaaagaattcgtttcatattacattttgcataaattggttccttatttaaatgaaatacgaatgaaacgtctatctcgcttaatcatttgtgttttttcgaaaattataatgtatacccttgttgtattgatgtttaatctctatttttgtctggcaaattaggctggcttatgaaaaatacaaagcgtacaagcattatcacactcgttctcctgctaagcatttttaaggtatactcacaatatatgtttcggcattgggatgtggttgatgggatgtcggataatcaaatacgatattttacaatggcaccggatggtcgtatggtcattcgaacagcttctattttaaacatctacaatggtgctacattcgaacatttttatcacgataggcggaaaatctataaatgggatttcaaccggaatcaaatatttaaagattatcacgatgcttacggacggatatggatgaaatctccgggatatttgttattattcgatttgaataccaatcagtttatttatgatattgattccgaattacgccggatgggagtaagtggaaaattgaagaatttgtttattgatgagagcaagaactattggtttcttaccgaagataatacattctatttttttgatatatccgcaggagaattacagataatcgaaaaggggaacagtgactttacatatcggcacggtattccgtacgagttagctcaatataagaatacttattatatcgtatattcgagcgggctaattcgtcgttgggccaaaaccttgcgagattacaccggtcaggatactttttttgtaggacgtatctctgaagctacagaccggttaaaaatacaatctacctccgatgggaatctatggctgatgtataatcaggctgtttgctatcgtgataaaactgataaaggttggcaagagataagcaccattaaaggtatgtccaacttctttacctgtatggatttggacaagcaaggaaacgcatgggtcggttcttcgtggtctggattgcggaaaattgaaaactctacacatagaattgaaacaatgcccggattgaaattaggtgacggcagtgtgttaagtaatgacatacagtgcatctttgccgataataatggcggaatttgggtaggcactttgtggcaaggtatctgttactataatccgagtatgtataagttcaagctaattcagactgttcagaataaaacaatgattaccaacgaatcggtgcgttgtttgttggaagacgaagacggaacgatactcattggtactactgcatacggattgatgcgttactctccttctacgggagaagtcagcagggcattcaaagatattctgtccggtgatctttgtctgactctttatagagacagtaaaaagagattgtgggttggaacgtatttgaatggattttgctgcatagatggaaaaaatgtgagatattacaataaacaattagttaatacagagttattcccggagcagaatatctcccgagcagtttatgaagatccggatgggcgttactgggtcagtgtcagtaatgaaggagtaggtgagctagacacctcaacgggaaaaatacgattgttgcgggataaacatccgaagattagctttcataaacgcgattatggtttttatcctgtcagcaattctacttttgcggtgtttggggaaaatggtatttactactatgatactcataaagataaaatctttgttcctgaaatagacgatccggataatcctaaatttatggggcctcaggtaagctataattgtgtgtacaaagatagccattcgctagaatggtttgggacggatattggaattcgtgtatgggacgaacaaaagaagaaagctcatacgataactacagagaccggattggctaacaattctatatcgtcaatcattgaggatgatagcggtatttattgggtatcaacggtaagtggtatctcacgaattgaattaaaagagacttctgaaggatatgattttctcatagtcaacttcagttcagaagacggattgcagggaggaaagttctatgagaattcatcgttaaaaacccgtgatggagaactgtattttggcggtcatcatggcattaattcgtttcaacctcaaaagatttattataatcatgtccacaataaacctatattcactgcattccgtctgttcaattctcctgttaaggaacacacagaatataaagggcgtgttattcttgaatatccgataaataatactcgtgagattcatttgaagtataatgagaactttgttactttcgaatttgccgggcttaactatgtgaatactttgcaaacctactataggtataaactcgagaattttgatccggactggaatgaaataaagaccaatggtctgggagtggctacctataccggtttacatccggggaaatataaattagtggtatacacagccaataatgacagaagttggggagaacaggccgcagaaatgactattgtcgtttctccgcctttttgggcaactgttcctgcttacatattttacatattgattgcaggtggagtcatctatttgtttttaaaagcttataggaagaaaaaacttaaaaagcagttcgaacaagaggcattgaaacgtgaacagcagaaagaagagcttaatcagatgaagttccgctttttcaccaatatcagtcacgaattccgtactccgcttactttgataatgacgcctttaggtatccttattcaacaagcggagaatccaatgaaggacaaattgaagtcaatctataaccatgccggtaatttgttggagttgattaatcaactgcttgattttcggaaactggagatgggaggtgaaagtctgaaattacatcaggctgacatcgtagagtttgtgcggtacattggttcagggtttaaagaactggcgacaaatcgatctataaagttttcgatagagagtgaatgtcctggcatgaatatctggtttgatgatacgaaaatgcaacggattctgaataatatttattccaatgcatttaaattcactcctgatggagggcttatctcaacgattgtagcgacggagaaaaaagatgaaaagatattcgtaagaatcgaaatatccgatacaggatgtggaatcagtgaaaaagacttgaatgtgatatttgaccgcttttatcagtcggagccaattcctggtgtgacaggttccggtattggtttgcatatggtcaaagaatatgtctctttgcataacggaaagatagaagtgcatagcaaaataggagtaggaacaacatttttgatatatattccatccgacttgaaaggagacgacagtgaatccaaaattccggctatgtctcccgatgtggaagaaaaggtggtatattcggacaggaaaactattttgatagtggaagacaatgtagaattccgtcgttttttggtggaacaattgataggtcaatttaatattctggaggctggagacggagccgaaggcgaagaagttgccatacataagtcgccggacctgataatatccgatatgatgatgccgaaagtggatggtctggaaatgtgtgtccggattaaaaacaatattcagacctcacatatcccgattatcttgctcacggcacgtatttcagacgaagctcggatagaaagttataaagctggtgctgattcttatatatcgaaacctttcaattatgacatattactgacgcgtattaatatgcttttagaacagcaggaaaagcgtaaggaaatatttcataaagaaatagaaatctctcctcagaatatcactattacttctttagatgaagaatttgtggagaaagccttacggttggtggaagagaatatggaaaatccggagttctcggttaataacttgtgtgatgacttggggatgagtcgtagtcagctataccgtaaatttgagtccattacaggattgacaccgaatgattttattcgttctgtccgattgaaacgagctgcccagttgcttcggggcagttcatataatatttcggagatttcggacagggtcggattcaattccattaaatatttcaataaatactttaaagaagagttcggattcactccgacgcaatatcgttcgaatggtagtggagagactaaataaaaagtctctccattcccatttatatactgaaaatgccctaaaaagggtataatgagacaaactaacctaataatcgggacaaattatctcaatggtgtcgattggattcgtctatttttgcagtgtgattaaaaataactatgaactgcaaaatgatggaaccatgaagaatattctatctaaaagaacatttattgtattaccactatttcttttttcacttcatccgctttggggacagaaaagtaactttaaaaatgacatttgtattccgggcaaactgtatatgctttcggatataaggaatgatgtttttgtcgaagcactaattaaaagatggagaccttacaatgactttgtgagattttcgggtgactgtgtttattcgagaaaactgaatcgtgtagcttctgtcgatactcctgtggatggatcgaatatgaaaatcgaattggtcaattcggatgagtttgaaataataaaagaaaaagcaatttctatatgcgtagggaaaaaaggaataggaactcaggaagttactgttcagatactgggggacagttttgtcaacggagcttttttcagggacgcgttgctgtcgaagaattatattcccggtataaaactggtcggactaaggaatataaagaatgaagaaggacaatatgatgaagggcggggtggatggacagtgaagaaatacttcgagattcctaaaggagagatgacatcatatcatggatatatgcaacctgtgggtgaatatagatattgggggagttgtgagttttggaaaaactgttataaggtgattaatggtgaactgacagatactgaaatagtctataactgtgggagatacgatcaatgcataactaaattcgataaggagacaggttatttggcagctccgaagaaaaacgatttaatgtatgataatgcacgtggaagctacatggtttatacaggaaagaagtggaagaatgttgaggttgatgagagaaaatgggctttcaattatagaaaatatctggatatgtggaatcttgatgcacctaagttctttgcacagatgttggggctcaatgattatcgcgacagtttgacggccgattatcgggaatggaataaaaagattgccgagatgaaagagtcatattacaaagctgtgcccgatggtaaatttataattctgatcccgtgtacaacctgtggttcgctcaacaatgtcagaggagattttacgttacggcagaatgcatccatgtggcaactgcgaaaaaatatcattgatacatttgatggtagggaaagtgaaggatactatgtcgttgacataggcattaccattgataatgaaaaagggtacaaccggaatcgtgacggaatacagaccggaaatccccatccatatcctaattatccgacaatgggaattcctcttgctgcctttattcaatattatagagaactttaaaataacaatgatggctaatacttttgatgatatcataacttgctcttataaagagtatcaccagataattctcaattacataacctatcgcatcactcatcgttgtgaggcagaagatttggctcaagatgtatttgtacgtttattggattataaacaaatgcttcgtccggatactgtaaagtatttcttgtttaccattgcccgtaacatcgtaaccgattatttacgcagatactacaaaaaacaagaagtgaataattatatctatgatatgatcccttcttttactaatgaaacagaagagaagattattgccgatgacttgtgtaagacagaacaacggatacttgctgcctttcctgtacaacggcgtacggtgtatgcgttgagccgttatgaagaaaaagatacggaagagatagccaatatgttgaatcttagtcagcgtacggtagattatcatttatttttaggacgtcgtgacatgcgccgatatatgaagaattgcatttaatatgaactgaatcaataaatagaagtgaagccaatgaagaaaaaaagcagaaaaagtaaaatgacgggatgtctgcacatcttgccgagtcttgagaataaaaataataatgtaaaaacctcagatttaatttcatgaaactccgaaagaaaatgctatgtatggtaaagcaggtgaagaagataacaatctttgcttgtttggtgtgtgtggtgtatcccgttgctgggatacaagcggctgtcggtgaacagcagtcggtagcacaaaccctgaagaaaattaaaggaaaagtgattgacgtgttaggtgagccgcttatcggcgtcaatgtgagtgtagtcggacaaacgggtggtacgattaccgacattgatggtaactattcgctagatgttcctgcgggtgctaaattgaaatttagttatatcggttacgaagaccaaataattgatgcaggtgtaaaagcggtactaaatgtgacaatgaaggagagtactgaagtgctcgaagaagtggtagttgtaggatatggcgcacagaagaaagaaacactaacaggtgcggtgaccgtagttagtgacaagatgttaaaggataagggagctctctctaatcctgcacaggctttgcaaggacaagtgccgggagtcattataacccgtaactcggctgctccgggagatgagagctggaatatgaaattacgcggttcattctcgaagaataattcagctccgttggtgattattgatggtgtggagtctgacgatttttcccaattaaatccgggtgatatagagtccatcaatttccttaaagacgcttctgcagctatctatggtagtaaagctgccggaggtgttgttctggtacagactaaaaaggccaaagaaggtaaggtaaaggtggaatatagtggttcggtaactgctaaattcgtagggttgcagcctacactgatgacattggatgagtggtgtgatgctatggaacaagctcgtttgaatgataacaaaaagctggcagacgatcaatggctgcaatacgtagctttggctcgtcagaataagggacattatattaatgtggagcagtcgggtaatcctttcccggattctttccaaggtttatacgacttcgtcttttttgataccgattggcaagatatcatgtgggggacagcagcttccacttcacatgaactgagcgtatcgggtggtaacgaaaggtctgtcttccgtctttccggacgatatatgtatgatgatagtaatttgaaatggggtaacaataagaatcaacgttataattttcgtttgagtaatacattccatcttacaaagaactttgatcttgagtctatcattttctattatcgtcaggatcaagtgtcaccgacgcaaattggagaagctttgacagccggaacgcaacaaccgggttttccttcttccacgatggatgggaaaccttatgcgtggggtaactgggctacgcccaactggcgttgtgaattgggaggagacaacaaactcaacacttccggtatcaatatcagtgagacatttaaatatcgttttgacgagcattttgatgcagtagccactttggggtataacacctctactgccattcgggacgtgaaaaaccaaacagtagattattatgactacactggtacaaaacgggaaacgcgtgtggaacccaggcaagaggatacttattatattaaaacaactgcacgaaccaatctgtatacgttaaatttctatttgaactggaagcggacattcggtagtcataacctcggaatgatgcttggtacgcaatatagcatgaaagaatatgattatactgcaactaaggctttgaatattttaccttcactgaatattatcaacggaataggagagataacattacgcaacacaaagaatgaaggaccttccagatatcaggaagcattgctttcttattttgcacgtttgaactataactataaatccaaatacttgcttgaaggaaatttccgttatgacggttcttctaaatttcagccggagaatcgttgggctttctttggaggtgtatccggaggatggcgtatcagtgaagaagagtttgtgaaagggctgggtgttttcgatgatttgaaactacgtctttcttatggtacagtgggtaatcagggaggtattgatcgatacgatggtgtgcagctatacgatttcaaacagaatggaggtgcattagtggggagtggtttactttcctatgtggatacaaacggtaagctgttgagtacagaccgtacatgggaagtcatcaagaactacaatatcggtttggatttcggtttcctggataatcgactgacaggtactgccgaacttttttggaagaagtgtaacaatatgttgattgatgtcacctatcctggaacattgggggataaagctcctaccgctaatagaggtagttttaaggcaaacggttgggaaggcacgattaactggtcggataaaataggagaaatttcctatcatctgggggggactttcacctataccactaacaaattggtagataatgggggtgacgctgtgattaaatccggtgtagtttcaaatcgtgaaggctatccgttgaattccgtgttcggtttgaaatattgcggtaagatacaaacgcaagatcagttggataaatatattaatcaatatgccaatggcaataacaatattgctatgcctggtaacttgcgtttgggagataatatgtatgaagatgtcaataaagatggtaaattgacagaagctgactatgtatatttgggaactgacgatccgaaggtgtctttctcttttaatgccggattatcgtggaaaggcttcgatgtctcggttattttccaaggagccggtaaacgcacagtatggcgtggtggcgaaaataatcaaaagggaaagaatgacaattggcggataccgatgatgtcttggtataataattcaacgaatcagtcggttggtaatgtatggtcggcagaaacgccgaacgcccattatcccacttacacacatcagacacagatcaatctgtataactatatttgttcttcctggtcagtggaagatggtgcttatcttcgtctgaagaatgttacgttaggctacacgtttccggcaaatgtgctttcgaagactaaattcataagctatgcccgtatttatgtatcgggagctgatttgtgggagaatagtaaaatcaaggatggatgggatccggaagcgtcgcgcaaagtagagacatttggccgctatccttttacgagaaacctgacggtaggattaaacttgaccttttaaatattaaatagtatgagattaaataaaataaaaaatctgtttgtcgttttaaccttgggactgtccacacactcttgccttgatctcgagccgcaagaacagttggcggaaacgaactactggaacacaccggatgactatctgctatttgccaatcaattctatggctggacacgtcacttttcaggagcaatggaatataagtcgacaaaaccggtacattctgattatacttcagatctgtttaccaataaagatgaacgtaatttatttagcaatggaagcaatgctgtacagcctgcggatgctaactataccagcaattactcgcacatccgccgtacgaatctgttattgaaaaatgcagagtcatatgccactccgagtgacatagcccagtatgtgggtgaagcaaaattctttcgtgcttattcttatttcgatttattgcaactatatggcaatgctattttggtgaaggaacctatggaggtaactgatgcgcgaatgtatgtcaagcagaatgatcgtagtgaagtggctgatttcatcattaaagatttgaaagaagccgttcctctgttaccgaagttctccgaaatacaagagtatgggcgcataagtcgggaaggatgtcaggcattcttgtcacgagtggcgttgtacgaaggtacctggcaaaaaagtcgtggtaacgtagaacgtggaaaagaactgctggatattgcggcgaaagctgccaaagacgtgatcgatagcaaaacattcagtttgttcaaaccggaagcattgggtgacagtgcacagaaatatatgttcatcttggaggatgcgaagtctaatcctgccggattacagaaaagtgctaataaagaatatatatttgctcggcgctttgatgaaatattggcacctatcaactggaatattacacaaagttcattatataatgcaatatggattagtcgtaaattcgccaatatgtatctttgtcaaaatggacttcccatcacttatggaggaaaaacaaaccctcaattcaaagggtatatgaaaatagatgatgaatttcaggatcgtgacaatcgtatgcgttatacaatgatgcgtcctcacgataacttttggaacaatcagaaaccacgtacttcttgggatggaaaggataagaacccatatatatctaattttgtgccgaagacggggaccggatatcacaatcagaaatgggcaacagagcgtaaggtggaagataaaaaagaaggttatgattttcctataatccgttatgctgaagttttgttgaattatgcagaggcagtgtatgaacgggacgacaagatctcgaatactgacctgaatatttccttgaatttggtgcgtctccgtgttaatccggctatgactccattgactaatgaactgattacccaaaatgcgggtatggatatgcggacagaaatccgccgtgagcgtaccattgaactattcaatgaaggcttccgcttagatgacctgaaacgttggaagacagcagaaacagaaatgccgatggatattgtaggaattcagtggaaaggtacggagtatgaaaaagtgtgggcgaattgtccttatgagaccaatgctgaaggttgtatcattattgaaaaggggcgtaaatgggaagaaaagaactatctgttcccgttgccgagtgaccagttgcagttgaatcctaatttgcaacagaatcccggatgggaataataataaaaacaaataattgtaagtgacatgaaaaacagatattcattgtttaagaaaggatattgggaggctggtgtattacttggcttatgtctgttaatagcttcctgcggagagaaggaatttactactgacatgcccgagaacaagttgattacagctatttcattggaagtgagtagtgaactgcctgtgcagttgggaacagatacaactattgtctatcatattactcccgaaaatgcggatcatacagagttgaagtggacgactactaacgaattggtagctacagtatcacaagatggaacgatttctgctaaatcgttgggaaaaacgatgattaccgtaactccatcggtaggatttggaacagcatccactgtacggactatcgaggtaacagtgattccggaagtaatcaagactaccgggattcagtttacaaacattgaggaaggagtttacgaaactgataaattacagttgaaatatgatatattgcctgctgaccatacttattcttatttgacttgggcaagtagcaatgaaaatattgcgacggtagataagaatggagtagtgacggggataaaagccggagatgtgactatctatgcatatacgcacgatggcagtaatgtaagaggagaatattcattgaaagtgatgaaatatgaacctgcgacgaatgttgagattgttcctcatacggatgttctctactggaaacagcaacttgatttagactttacactaacaccggaagtagctactgtaagttctgtggaatggacatcaagcgatgagaaggtattgactgtggaaggaggaaaagtgaaagccatgggcttcggagcagccactgttactgccacttgtatagagactggcaataaatcgactatcgacttgactgtagcctcaggtttttatgtatgggatgccacaacagactttgagggatgggctatcaatagtaatattggctctatggagcgtaaagacggaaaactggttatgaccgtgactgctgataataataagcgcgtgtatatgcaaagagtctatagtacggtagctaatcagatggatatgaattttaaagattatccggtgattgccatgaaatgcacagatataccatcgggtgcacaatatactcttaatcttgctaacttgggaaataccgtaaatatcgcaccggctatgaaagttgagaaattgtcagatggtacacaactggtttattatgacgcatcttccttagcacagtttaccaatacagaaggggttgttccgattagagcctttatgttcaagatattaaaagtcgatattccttcattctcggcagactggatacgtacatttaagagtgtagaagaaatgatgacgttttcagaggttgaggctgggaaataatatggacttatattcaccttatagttaaatgattatgaagatagattatataaagaatcagataaaggtagcaggcatggtgattgcctgcacctcactatgctcgtgtaacagtgaaatagaagatgggacgaccgatatagatagttggccgttgcctcgcatagaagtgacctaccctacggaatttgaacacccgggagttgtttttactgtagaagacatcgagcgttttcgtaagattgctacccaacagatacaaccacaatatgcgggttatgaattattgagcgcggataaactctctcaaagtacatatataatgaatggtccttatgatgaaatttatgccggtgaagatgcttctcatccgaacatcatgaatcaatttggaaacgattttgcggcagcttgtcagaatgccattatgtttgctgctacacaacaaaaaggctatgctgataagtcaatggagataatacgtggctattccgccagccttaaaaagcctgtctatagtgcgagacaagccggtttggatcatgtattgatggtgggtaacttatgcataaaactagtttatgctgttgagcttatgcgatatcttgatggttccgggatgacgaatgaggactttcagggagcatgtgatatgtttaagcggtgttttattcccgtattagatgatttcttctctatcatagagcctaagaataaggcagtcggtaactttggcgtatctgccattaactgttacatggccatggcgattgtattggatgatatggaaatgtataagaaagctatagatatttatctttacggatatgaaaatggttctatacgttattatatagatggagaaactggacaatgtcaggaaagtggtcgtgaccaaacacatgcacagttgggattaggtatgatgtccatgctttgtgagacggcctggaaacaaggtactgatctctacggtgtgttagacaaccgcttgccgaaaggctatgaatatacagctaaatataatttagggtatgatgtgccattcaagtatatgccggaactcaccgggaagtataattggtatgaaatagacgaagtagacaagaaagaggtagccagtggtcagagacctgaatcaagacgtggtaaatttgctcctgtctatgagcgggtgtacaatcattatgcgacacgtttaggattgggaatgccttatgtgaaagaagtcttagaaacaaaggttcgtcctgaaaacgccggtactgatattgctcatttggggtatgggacttttctgtattgtagcgaaggttttgaatagtagtttatgaaaagactgttttttatattcatttctttctgcatggcggcggctctgtccgcccaattgcaggaaagaatggttaaagtgaatgttgtacctgatcatgtcgattggaagtacgaactgggtgagaaggtgaaattcaacgttgtggtgacaaagaatcgtgtacctcaagaaaatgtgactgtatggtatgaagttgctcaggatatgatgcatccattactcaaagataccattgtcttggaaaatggtgtgctgacattggatgccggaaccatgaaaactcctggctttttgcgttgtcgtgtctggacaaaatatgacggtagaactgttgaaggacgggctacggctgcctttgaacctgagaagataaaaccgacagctgttttgccaaacgatttcaatactttctgggaaagtgccaaacaggagaatgttcgaattcctatgaatgtgaaattgcgtttactgcccgaacgttgtaccgagaaggtgaatgtttatgaatggaatgtacagaactaccgtttgaacagccgggtatatggtattctttgtgtgccggtaaagcccggaaagtatcctgctttattgcgggtaccgggagcgggagtacggggatatgccggtgcgattgtagaagcggaaaaaggtatgattacgttggagattggcatccatggtattccggtaacattagaaccgtccgtttatgctagtttgagccagggaggactttatcgatatcaatatcagaattgggacaatcgtgatgaagtttattataaacgcgtctatatgggatgtgtacgtgcggtagattatctttgttctatgaaagaatttgatggcagcaacctcttggtgcagggaggtagtcagggaggtgcgttggccatcgtcacggcggttcttaatccgcgtgtgacaggagtcgttagcttctttccggcacttagcgatttgagcggctatgagaaaggacgggcaggtggatggccgcatttattcagagactccaccgatgctgtcgaaatcagaaagaagaaattggaagtatcttcttattatgatgtggctaatttcgcaaagcagctgaaagtcccggtcttcttctatttaggatataacgacatggtatgtcctcctacttccacattttctgtatataacgtaattacttcccctaaagagattgtgataatggaggaagccgagcactatgcttatccggaacattggtcacaggctttgcaatggatttattctaaacagggaatgtgagaggggctcttatgattcgtatgttactactcatattagatttgtacctgttttattgtcatactgtcagggatacattcaagtagatgaatatcagcactctgtcacctgacaataaccattgataataggctgacaataaaatatcccgacttttattgtcagccttacttttatctcttataatacctttataacctgataaacagtacctttataagtatgcttcgaaggaataccgcatttttgcagcaatctcccgaagtgatatactttgttatcagacaatgatataccgcttttctttttcagataatttagtatttcgaccggagtaagaaattctccttcctctttcgtttgcgcagctttaaaatactgataaaacaattgcagcatagccggtgtctgctcaaactcacggttgttttccgtcataatctgctcatcctcactgtcaaaccagtagcgttcgccatgatgaatctcgtgcatggcttgtgcataaagctgttcataatctatcggctgtgtagtgtcgatgtttcccgtcacttcaatacaaatgacacggcggcttcccgaaggatcagtcagcaaatccttctgattgcttgtaccgataaatgaagcataccgctgcaattcaagtaccgagcgaccgtgcggtttccgtagattgaccacaggcttttgaagaatatgtttcagaaatccctgttgtggcagagttatctggtcaaactcatcgatgttgatgagcgcaaaccgattcagatacagttctgcatcccgtttatggctgaaatcaatgctgtctgtatagtaagcgcgaagtgcaggtggaatcatttcacggcagaaagttgacttatgagttccttgtgcccccactaatatgggcgatgtattattcgcatgcattttatctacccctctccaatgtgaaaccatattcaggaaccaacggtggaaaagcaattcccaatgcggattcttgcaaggaaccctgtttgccaaagcatgaatacggtctttgccgtcccaatgaggcagatgaaacagaaactcttccaacggattgtagatcggcacacggttggaatgtaagtatcggtctatatccctatcccatacgccaataccttcggattgtgcgtcgagcatgatgctgttttgtgcccgtttgtcaatgggatgaaagtaaaactgaaacgagaaacgctcccgatattccacttccccgatctgcgtattataacggaactcataacgacggttcataaattcatccatttgcaggctaagacgttgttctttagtcaggcagctgcttttgggcactcccttacattccttatatacgtttcttatcatttcgcgtaccagcatcggattttttcttttgtaataacgcatgatggttcgtcgggttacctcctcttccgggatgccggagtagtaacaattttcggcaagcgggactactaatgtttgcaaatcatgatcgtttcgatgccagtccgtttccatttcttcgaatgttttccgcaatgccgcttcataaagcaatgctaccgtatcttccgtgtcataccccggcagtgctcgattcagcggagatgcttcagtgctcgatttctcatgataagtcatctcgccgggcataccgatgggctgtgaaagatagaaaggtacgggagcgggacgataaatcaagtccggatcataactaagacgtgagaattgttccagtttcggctcttttaatagaatgttgaagggaagttgaggctgataacatttaatggcaagccggtaagcatgtgcctgaaacacttcggcttcttccgttgtttgcggtaaagtgccgtccggacgggtgaagcaagtccatatcttgacgcttttaccacttgctcccataaaagccagcattgtttggggaagttcggcagccttttgcttcacgatttccacttctgtctttccggctagcggaccgatggtcagttctacaatgccattgtaggttttcattcgcttcactccgttcactcgcccgaaggctgctgcgggaatcactcgtggtagtttgctggcgagggaacaaggctcatcgggtagaacaaaatgcagggcctgacgtaatccggttaccgggcggagcttggtttcttttttcattttttctatcagcaggtcgatgtctgttgcgcttagtgcctccgtatctccgttttccctgatttgtgtaatcttcatttttcttctcttgatatttaatgagagtaagtgtttgttattggtttcaaaggtacggataaggtatctgtaaagcaaactatttgcgctttatcgcgataaagaatgtgctttcttgttatactctattcaagaaggcggacttgaaacattaacaagcaagtaaagatatgctcgccactgtgtattgttgcataaagacaccgttattcttacgttaacttaccggtattggtagttcgccacggccgtgacgagatcttcccacggccgtggtaggaattcgtcacggctgtggaaagaagtaaccacggccgtgggaaggtaaagataccggtactttagctgaacaatactgctgctttagccgaacaatgctgctgctttaacggaacaatactgttactttagcagaacaatacctgcttctttagtgaaagataccggatgtgcagtactcatttaacggggcgacattcgcttcgtagcgagtttatatttcttataggctctttgctaatattgaacttcctctctttcaatacaaaacttcctgtatttatttccgtatttccactttgtttcgaaaaaaaagcatatctttgtcatacgctttctgttcaccagcgtgatgaaacaggtaagaagcgttttttatttataaataggaatattattgcattatccctcgtatttgaaatctagcaagtttctgtccgtagagggggggcaacagatattccacgtgaacggccgtatgtcaacatatcgatgaaagatgtgttatatatacacaattagcgtggatgtctgttgttatcattatctttcggacgggtttgctaggcctcaaatacggataatgattcaacagcattcacgcttttttttgtatccggttggtttcataacccttaaaaatccccaaccccaatctcctgtccgcccggaatacaaaaagcgcgaatgtttgttgaatcaacatcaacagagcactatttattccttgttgtataacaaattaaaaacaaacactatgtcacaatggattagcatagaagcggcagccgagaaataccgactcgaaaaagagtatatctggctctgggtggaaatgaaaaaaatcacagtgtcttatgagaacgatacagtttccatagatgatgatagtatccagcaattcataaaacggactaagctgggaattacgtctgaatatatcgatgagttagagcaactttgcatggaaaaaaacaaaaccagcagattgtatgcttcactcttgaatatgcgggatcaggaattaatggcaattagaggacaaagttcgcgactggacggtttatggaaaatggtggaggaacaatacgaaagactgcgatccttcgagaagaattctatgtcggacaacgctatttgtagcaactgctggatcagaaagatatgcaggagattgaaacgaattctataattctgctgtgaatttatctattaaataacaggctgacaataaaagtacgatctttttattgtcagcctattgtcatagcctattgtcagggtgcaatgagttgctagtcaccgtattatccagccaaaactcctgctgacaataagaaccctccaatttatatgtaaacctaaaacctatgaaacttttctgttattaattacacgcatggccgcagtatagtattcgcaaggaacagaaatcaaaatactgtttaaaccattgtctttcgttgacacttgaatataagctgcattcaacaaactctttacgctggctacttcccaaggactaccagcaaaaactttgacttgagaaatctttctacttgtaatcatgatctttatagtgtgtttttgtttttactgcgacaaagataagagagaaaagcaacatagaggtgcaatattgtttcatctatagtatacaaatgattcattgaatcaggatttgtattaattgaccagttttttgcgttaataagagttgttttccctcacatcattcatttcttattttgcgtatttgttattgtttctacaaggctattgatataaacctctatattatcataggcagtacttagatttcttccgtttgcatcatatttgtttgggttcaatccgttggcggtttcccattcgtcaggcatgccgtcattgtcagaatcagtaatttgtggcaatgattttaatgttggccatgcgctccagtcgctaccagctccggaaggctttaggtctttctgactatcgataagtccgcccttaggataattctgacttttccaatggatgatacctttgtcgcaatgttcacaaggaccgttcgggcagggggcatctcctaatccgttgtgttcgttctttccgatgaattgtgccgttcctgtgcgtgtctcttcaacgatacgagtatctatatcatctcgtttgagactgcaacccgcatatttcaacaccagctcgtaagctttttgtgctgtgtgggtagttaccgcatctacttctaccggagtatcccgtttcagttcatcgagagagtgaccggtgttgttacggataccagtccagttgtctttgttcacttttgcggcggatgcttctgtcagttggtttcctgcctcgaagtgattccggctgatatgatactgtcccaatacccctttgatcggtgcaaaatctccatcagaagagctgatgtcgatagccatcacacggttggccactttggcatccgtagcgggtccgggtttgtagtagttgtccacaatgttaatacccattgctgcgccgccataacatccgttaccgctccagttataaataacattattacgcatatcagtacgttcctgaccttgatattttactccggaaccgaaacgtggtgtgcgactgtcatggtgtgccatcagattatgatgataggaagcgttgactcctccccaaataccgccatatccatgagggcctttggtatgtcccgataagcggagactttctgaaataatacaccattgcatagtaaagttagtattatcatagaatgaagcacattcgtcagtgctccaactgatggaacaatggtcaatcatgatattgtttttctggcgtcctcccagagcatctgcaccgtcggaagccgaagagcccagcaaatccgtatctcccattcggaaacgcaggtatcgtagaattacattatcggccgatacatttactggaaagtgagccaggcagataccgtctccgggagctgtctggccggctatcgtgacatcaccgttccgaatgtccagtgtcgattttagataaatggtgccggatatacagaagacaattatacgaggctccttttgttcgatggcataccggagggtacccggtgctttggagtcttccagggatctgacaatatatacctttccacctcttcctcctgtagtgttcattcctcctccttcagctccgggaaaggcatatgctgtttcttctactggtggagatacggagggagaatccggtggagtctcctgttctttattatcttcattgactgaagatgtggaacaggaggagaacgattctacttgtgtggcaaacagtagtgccacgaaaatgaattttaccttgttgtttttcatatcttacctgattttttataaaatgtgatgatagtgatactgatacaaatgtaagtggatagaatttgatagacaactggttgcatagatagtgcaccagattgcacaaaaagtccgcaacttttgaatgatattaaaaaagtccacgcaaacaaacaaatagtgagaaagtattcatgttgttccgtatacttttgtaacgtgaaatagtaactgctcaaggcaggacgaccaaataataatggaataagaatctatcattaagaatataacaaataatttatgaaagcacatttattttcaaagatgtcccaaggactattgttgttatcagctttgctggcaacaagttgcaaggaaagtagcaataacttttttgttcccgaccatgaagccccttctttggtgtctgtaactcctgcaaatggtgaaacggccgaagaaaacaatacgattctgcttacttttaacgagtatgtgaaagcgggagaagggaaagcgaattttaatggcgaggaagtggagttgactttcaaaggtaaaacagcgtcttacgcttatactgctttggactataatcaggcctgtcagttcagcctccccaaaggtgcagtcatagactttcagggaaatgtattcgaaggtgttagtattcagtttacaatcagagaacgtcctcaaccggaagcacgcatatttgatgcggtggtcagtcctgacggaaaaggaaactataccagtatacagaaagcaatagataatgtcccctcgaaaagaacagaaccttggcttattttcgtggcgaacggaacgtatgaagaacaaataatcattcctgaagacaaaccgtatattcatctcatcggacaggatgtggataagacaattgtcaagttacgaattaacagctcaaccgaagccagtgcgactgatccggatgtgtggaagtactcttataagaacttaggaaaaacggaagccgctatggtatcagtgaaggctacggatttttacgcagagaatatatcttttgtaaacggatatggcaaagaattacagaaaggccctatggcattggcaatgtatacccagaatgaccgcaactcattcaataattgcaaattcctctcgtaccaagacacctggcagaccgggcctaaatcggataacggcagactgtatgcacagaattgctggattgaaggagccgttgattacttctatggaaacgggaattgctttctcgaacattgcaccttttataatatgagggatggcgcaattattgttgctccttctcataaagtaggaacacgttggggatatgtgttgaataattgcattgtggatggaaatgaattggctgatacagaaagtgtcaagttggggcgtccctggcacaattctccgatagctgtatatctcaatacgatttttaatataaagatagctccggaaggatggacggatatgggagctattcctcaaatgtttgctgaatataacagtaaagataaggaggggaatactgtagatttaagtcagcgtaaaacgcaatatacctatcaggatgaacaagagaatccggtgacaggcatttgtcaggctgtccttacggcaggtgaagcagctcggtatacgtatgaaaacgttgttcgtgagggcgataattgggacccgaagaaatatatggaacaaatatccgcaccggaaaatctgaaaagagaaaacggaatattaagttgggatgcttcaaaatatgcaatttgttatttggtaattgcgaacgatgaaactgtacaaataaccaaggaaacgtcttgtaatgttgaggaaggaaagacatatcaggtgaaggccgttagtgagtatgggtctttgagtgaaccttcaaaagagtgatgacaattaaaactttaaaatatgaaaatgataagtaaagtattcagttgtatgttggctttttcttctctgttggggaatgtggaaggacaaaacatctatagaatatggtatgacaaacccgcttcttattgggaagaagcactcccggttggtaatggacggattgcagcaatggtgttcggtgaccctcaactggaacaaatacagttgaacgaagaaacagtgtcggcgggctctccttaccagaactataatgaagaagcaaaaacggctttgccggaaatgcgccggttgatttttgaaggaaagtacgaagaagcgcagaacatggcggcaacgaagattctttcacaagtggggaatgaaatgccttaccagacagtgggtcgtctgaatattcgttatcaagatcacaaaaaggtaaataattactatcgtgatctggatataagcaatgcagtagctgtgactcgctacgaagtagacggagtggaatttaccgaagaaacatttgcatcatttaccgatcaactggttatcaggcatatcaaagcatccaaaccgggaacaatcaattgcgaactgttttttaataccccgatgagagatccgaaacgtagtatttatggaaagaaaggtttgcggctggaaggtattacgcatggcagccgttattttccgggtaaagtgcactattgtgccgatttggatgtgaaacataaaggtgggaaagtgataactgccaatgacacgttgcttagcgttcaaggagccagtgaacttacattgtatatctcgatggcgactaactttgtcaactataaagatatatcgggcgatccgtatcaacggaataaagcttatttgaaaaatgcagcgaaagattatagtaaagcgaaagccgctcatattgctgcttatcagaaacaattcaatcgtgtaactttggatttgggtgaaacttcccaagccaataagccgatggatgtacgtatcaaggaattttcttcatcctatgatccggcattgatagcattgtatttccagtatggacgttacttattgatttcatcttcacagcccggatgccagcccgccaacttgcagggcaaatggaatcataacccgggacctccctggagctgcaattatacaacgaatattaatgctgaaatgaattactggccggcggaaatcaccaacttggccgaacttcataaaccattcatccagatggtacgtgaattgagcgagaatgggcgtgaagctgccagtcgaatgtatggttgtcgtggctgggtgttgcatcataatacggatttgtggcgtatgacgggtgcggtggaccgtccttattgtgggacatggcctgtggctaatgcatggctttgccagcatttatgggaccgttatttgttttccggtgataagaagtatttggaggaagtatatccgatgatgaaaagtgcttcggaattctttgtcgactttctggtacgcgacccgaacacgggttatctggttgtcactccttccaactcacccgagaattctccgcgctggataaagaagaaaagtaatctttttgcaggaatcacgatggataatcagttggtttttgatttattttcaaatacatgcgaagctgccaaagtgctgaacgcagatactgatttttgtgatacattgaagaatatgcgccggcagttgcctccgatgcaggtagggcagtacggacaattgcaggaatggtttgaagactgggatcatcctaatgatcgtcaccggcacatctctcatctttgggggctatatcccggttatcagatttctccttatcgttctccggtactctttgaagcggcaaaaaacacattgatacaacggggagatccttctaccggttggtcaatgggatggaaagtttgtttctgggcccgtatgcttgacggggatcatgcttatcagttgataaagaatcagctgacttatgtcagccctgaaatacaaaaaggacagggaggcggaacgtatcctaatttattcgacgcgcatccacctttccaaatagatggtaacttcggttgcacggctggtattgccgaaatgctggtgcaaagtcatgatggtgcgattcatctgttgccttcattgccttcggaatggaagagcgggacagtgaaagggttgcgtgcccggggaggttttttgattgatgaattgacttggaaggacggtaagctggtaaaagctgtgttacgttcggaaaccggaggcaatctgcgcctgcgctcttactggaaattggctgctgaaggagcattgttgaaacagaagaaggaagaggaagcgaatccgaacgcattatttaaagtacagcaaatctcacgcccgatgattagtgaaaaagcgcctttaaaaggagtggcattacgtgatacttatttgtatgatgtggatacacgcgaaggagaggtgattattgttacagtaaaataagacattctatataaaaagtccacgcttttgcataaataatgagtggaaaacagatgtaaaagtgtgacttttgtaacatcaaaaatgaaacaaattaatcaagataatactatggatgtacaaagacatttatttttgagaagatgctttgcgtatatatgttgcttgctcttgtgctttataacggcgacaacagtatatgcacagaaggtatctgtgaaaggaacggtggtggataccaacggcgatgctattattggtgctagtgtgaaggtgttgaaaaagtcctccgtcggtacaattaccgacttggatggaaatttcactttgtctgttcccgaagatgcaacaaagttggaaattagttttgtaggaatgaaatcagttgttgcgactgtgaaaccgggcaaacatctgaaagttgtgttggaagaagacaatcagactttggacgaagtggtagtggtaggatacggaacctcacgtcgcggagatttgaccggtgcgatttcttcagtgagtgagaaggttttgaaggatattccgataacttctgcggctgcggctattacaggaaaactggcaggtgtgaatgtagtggctactgatggatcgcccgatgcaacaatccagattacagtgcgtggcggtggttctattacccaggacaattcaccgttatatattgttgacggttttcaggtgagtaatatcaatgatattcctcccggtgatattcagagcattgatgttttgaaagatgcttcttctaccgccatttatggagctaaaggtgcgaacggcgttattcttgttactacaaaaagcggtaaggcgggaaaaacagaagtctcattcaatgctcactggggtgtcagtaatgtgtataatctgacgggggtactttcaccttacgaatactactgttttcagaaagagcttgatccgggcacctctctgaccagtagcattaattcgatgtatggacgttgggacgaccgcaatatttatcgttcggtagaaggcacgaactggcaggataaagtatatggaaacaccggattcaaacaaagctataacgttggtataacaggaggaacggatgctacattgcgttataatttgagttatacgcgggatgatgagaagtacattatgctcaactccaattatgtgagggataacttgagtgtgaagatggataaaaagttgagtaacaaattgaagtttgagttttccagccgtttgactagaatggtgattgacggtgcgggtaccaatggaggtaaattgagagatgccgttcttttctcgccaatcaacagccttgcaagtatagatgcgggagatgctttggggggtgaaattgattactcggatgatgcattgttatcatcattgaatgatcctgtatataatacggtgaatgagtataagaagcaaaaccagttttctatgacttataatgccggctttaactgggaaattgttaaaggattgacttatcagctgaaaggtagttacgcatatacttataattataccgataatgtctggctaaagaaaaccggagagtcgagttccaacgctggtcagcccgtagccaaacgtacggatgagaaaggtgcacgatggaacttgcagaacatattgagttaccggttctctctgaaaaagaatcaccgccttgatctgatggccggacatgaaatggtgagtaattacagaaatcagatgattgcctcatccaaatattatcctatggattttacggcgagcgaagtgttggctatgtggaactatggagaatcccaaccaacgtataccactcttggtgaaccttcccgtacggcatcttacttcggtcgtttaaactatgctttcaaagaccggtacatgttcacttttacagcccgtgccgacggaacgaatgtgttcgctcctgaaaaccgttggggatttttcccgggtatggcattggcatggcgcatttcccaggaaaaatttatgaagcagacggaagactggctggataatctgaaacttcgtgtgagttacgggtcagttggtaatgcgcgtgtcaattcatactggagacaggattataaaatggaatcttctgccaataggcaatattatctgaatgaaacagtacagagtgccctgaaattgcagaacaccttgcggaacgagaatctgacttgggagacgaagttatcctctaatgtgggaatagatgccagcctctttaatagccgtttgaatgtgacggttgacttctataatgatataacgaaagatttaatcttacgcatggatcttccttcaaattcgggatatgaatatcagtatcagaatgtaggccgcagtacgaacaggggagttgaacttacgcttagcggaacgattatcaatagtaaagatttctatctgggcgctaacttcaatatatcattcaataaaaatatagtgaataaactggatggaacggcaaccgtattgagtgcgcaatccaactggcgaccggatatcggctctgatgattttcgtgctattgtaggtcaggcggtaggacagatttatggtttcgaagtagagggcttttattctgtagacgactttacgtttgatgagaatacgaaaaaatggatactgaatgaaggggtagtagacgacagggctttgttctctaatgacctgcctaactttggtcctggctttatcaaactgaaggatcagaataatgacggtgtgatcgatgcggataatgaccgtaaagtgatcggtagtgtacagccaaagcatattggcggattcgggctgaatgctgcatggagagggtttgactttgcggcaatgttcaactggtcatatggcaataaagtatataatgccaataagattatggcatccactcatacgaatcgtaaatataataatatcagagattttatgagtttggaaaaccgttggtcgattattgatccggaaacgggtgccaatgtaatgtatggtaatgacgccaatccggaacgctttgttgaaatcaattccaaagcctctatctggatgcctatgatgggacgtacgcttgtgacggactgggcgattgaagacggctcttttttgcgttgtagtaacctgacgttagggtatacgcttccggttactgtgactcgtaagctaggagtcaagaacctgcgcgtgtatgctacggccaataacctgttttgctggacagcttattccggacaggatcctgaagtgagcacacaacgttctacccctttgactccgggtgtggattattctgcatatccgaaagcacattcttatgtattcggtcttaatgttactttttaatacttgaaaaatgaaaatacagaaactatttttagcggttttatcctcctctgtgttatgcacttcgtgtatggataattttttggataccgaaagtccttctattccaagtgatgagaatctgtttaaatcgacagctctgacggaagcagccctgatgggtgtatatgcgacaatgacggacacctatatatatggtcagaaactgtgtgtcaactggcagggagcttctgacgtggaggttggctcgggtgcgttttctacggaaaactataattcgacacttcgtgatgaaggtgctggcaatttttatgacgataattataaccggaataccagatgggacaaactttattatctggcagaatccgccactactatcgtagatggtatacgtcggtcaccgttgatgcaatctacttcggacaaggctgccatgcgtagatatttaggagaggcattagcactaaaagcgttaggctattttgaattgatccgttattggggagatgtgccatataaagagcatgcgtctgaaagcggattgggaaatgtctatataggaaaagtggatcgtgatattgtttataattatatcatagaggatttgaaagaggcaattgaatatctgccttggatgggagaagaatcatatacggtagaacgcatgaataaaggttttgccaaaggactgctggcaaaggtagcgctatttgctggaggatggtctgtacgggatggaaatcagtttccggacttggatgtggaacatcatccgaccattccggaaatgaacggatatttcgtcggtcgccctaagaattggaaagattattatgaactggctgccaaacagtgtgcggagattttgggagcgactgataatcctcatgagcttgatcccagttatgagaatatttggtctactgtcaatcatctggaatacaacaagtataatgaaaacctgtttgaagttgcttttggtgaaggacagaatggagatgtgggggccacgatgggatacaacctgaacagaggggtttttaataccacccaaggtatgggaggggcaggatatgcggctactactgcttactatttttattcatttgatccggcagacacccgtcgggatgttacttgtgttttccaggaatatatcaatgagaatggaaaaaataaggaagttattcgctgtaatccattaggagtggcttgtggtaaatggcgttggtattggatgactgataattatatgaaagtccgtttcccgaaagctaattcacgtattgctactggtatcaactggattttgatgcggtattcagatatttacctgatgtttgcggaggctcaaaatgtattgacaggaccggatgcagttagtccgattgccggtatgtctccccgacaggctttggaaaaggttcgtgaaagagcatttggtactggtgctcccgaaatcacgcagtatgacgcggatttcttcacggctattgtcaatgaacgggcatgggagtttggatgtgaatctattcgtcgtcaggatttgacacgttggggattgttggcggagaaaatagaagagatgaaaataggtctttgtatgttgtatgactacaagccggtgactattttcgggaagacttatcaagtggatgaaataccgagaaaaatctattataaatatgaagactctgataatccggaatacattgatatgtcgtctgttaacttcaatgaggatatgggaaccggtactgcttctgcatcaaaaggacagtatgagtgcaactggatcagtatgcaggtgacattgaataaggatggtgatataaatgcaaccctgaatactaattatgtgaaaacaatggctagaatattggtttgcggtacagggctgaatgcgtcttacgactattcgaatttgtttggcaggctgaactggggcggtgaagccgaagcggagttccgtaaatattctgttggtaatggagtgtgtaattatcgccatgtattcgctatttattatgaggatgtcaataagacgcaagggtatgtttctaattcgtatggttataaataattaatggtaggaaaagatgaaaagactagttaatagattatccggagcatgcctgtatgtactattggctttgatagtgggtatgtcttcctgtgaggacgatgccaatgactggacagttaataagaactatgatgctttgttccgtccgttgacgttcgataagtcggctaccgatgcgacttcggttacattaagatattcgcagattgtgaatgcaaaagtctatatttttgagttttatacggacagcttggagtttaatgcggaaaattatgtaaggacagatacgattctgaaagatacattgactgtattttcagagagtaatacgcctatgagggtggaatatcgtactttgtttcaggagttcaacggttctacgcaatattctgttcgtatgaaaggagaagatgcgcagggaaaggcaagcacttatgtcagtgtagcatttaaaactccggatgagcaattatttaccggagtggaagttacagctaattccgcaaccttgacatgggaagaaacgaacagggtaactcatctgacgttggctcaaatggtggatacgaaatatggtgaggaaaaacagattgatttgacttcggaagatatagcggcttgttcaaaaacactctccgaattggagaatggagcgacctatcgtgttcggatttataataatgatgcattacgtggttcgtatgtattcaagacactgggattgggtggtagcgaaatcctttttgtggaggctacggaaaccggagtcattgatttaagtacattgttatctaattttgtgaaagagaaagaatgtagcaatgtaactgtccaacttactccgggggcggtgtataaggtaagtgaactaaagattccgggattggataatattttgtttaccagtacggaagctaatgaaaataatcgtccacagcttattgtgactaataaaatatcattggcttctccgatacagtctctgtcattcgagtttgtttgcctgaatggaaatggcgaggccagttatatgacggattggaaaaatagttcttatgcccagtctatttcatttacaggatgtgctatacagaacataaaacgtacgcttgtacgtattagcgatggaagtggtgtgttcatgacggatattacgattgataactgtgtcatatccgaagttggtacggacggatatggaatgattaatttcggaaaaaatatcgatcagttggaaaaggtttctataacgaatagtacattgattaatattggtgaccagttgatggacgtgaaagggggaatcggtgatgtgatattggaaaattgtactttctataattctatggatgctaagaaggaattgcctaaagttttccgtttcgataatgcggcaagtactccgccttctccgaaatctgcgacaatgcggaatttgattttctccggtccgaacaaaggaaagaaaatgaatagtggaaatggtgcttatgacattttgaacttctctgataattgttatatcacctccgacctgcaggaaggcaataacaggtttgaagaaataacgagaataaaacaaagctcggatgacttgttcgttgatccattgaacggtgatttccatattaaaccgggagccgggttcgccggaacgggtaatgctggtgatccacgttggtattaattgatcctatacttgttaggtataaagaatatcatgaagaatattgtattatcaattttattgatgagtgcctgtgcaatgatttatgcacaggcggactcatcgccttatcaggctattgtagctgttgatggtagtggagattataaaacggttcaggaagcaatcaatgctgtacctgacggacagacgaaaccttggttgattctgataaagaatggcttgtataatgagcaggtgattatccctaagaataagccatacgtacatttaataggccaggataaggataagaccattattcatttaaacttgaatgttggtagtaaactgaccggtaaagaaataggtggaaaaacagcttattgggaacactcggttcataatccttcctctccagtttataaatacgagggatcggtagtggtggtaaaaggagaccacttttatacggaaaacatttcgtatgtgaatgactggggagttttatcagataatggtccgcaggctttggctatgaatagtcaggcagattgtgcttccttttataattgtaagttccgttcttttcaagatacttggatgactgccaataatgatgtcagtcggcactatgtgaaagattgctggatagaaggcgcggtagactatttttatggtggtggtgatgtgttgctggaaaactgtacgctttataatgtacggagtggagcagtaatagtggctccttcccataaagatgctaaatatggttatgcttttcgtaattgcactatagatggaaacagtgaagcggctgacggacgtttgaagttggggcgtccatggcataataattcgaagacggtgtatatcaataccatcatgcttatccctgtcgctgatgaaggatggacgaatatgggaacggttcccggaatttttgccgaatacaatagtcgtgatgcacagggtaatgtgttggatttaagtaaacgcaaaacggaatatcaatataaagaccgccaaaccggtaaggaagtatcgggtacctgtcaggcaactataacgaaagaggaggcggacaaatatacgtacgaaaatatgattccgggtaatgatggctggaatccgcgtattatgatggagaaattaggaagtccgcgcagtctggtttatcagcaaggcactcttaaatggaatcctgtgaagaatgcgatcggatatattgtatatgatggagaacagattctcgggacgactactgatacctcttttccggtgtcggaagtgaattatgctttgaaggtatctgccgtgaatcaatatggaacgcaaggtaaaaaaggtgtattgtaattgaatatagaaaactggtaaggaaaggggaggtgcttatgaggcatctccctttctttctttatattctgtaggagtgactcccatgatttttttgaagcgcctgctaaagtacttcgggtcattgaaaccggtcatataagcaatttgggagaaactgtattcacttttttcaattagctgggcggctcgtttgatgcgcatttcacatacgaaatctaccggagtcagcccaacaatggattttaattttcggtagaataccgtacggcttaacattagtttgttggcgaagtcgtcgatggtgatatctgtattatccatttgttcctccataaacgccattacttgttgcatgaattgttcatcgtatggagtcacttgaggttgtgaaggctcccacccatttatatgatcctcttcttgagtatgctctgacagtttcgataaatatagatcttgtagctgtttacgctgacggagcagcgacaagattctggtttttaagtatgtagagctgaatggtttggtaatgtagtcatcgataccttgttccagtcctgctatccgatcatctaaagaagattttgctgatagtaatataataggaatatggcaggtgtcatgatcggctttgattgctttcaccatgtctaatccatccatgaccggcatcataacatcactgattatcagatccggaatgtactgctgtgcatattttaatccttcttttccatttgttgcttcgagaacagtgtaagtctctgacaggatattccataggaaatgacgtaattcattgttgtcttcgacaataagaatggaagttttttcatcctctgcgtcggttttattttcattctctgcgtatgctgccttgaaggatgtactatccgaatcttcttcagtagcttgtatcgtcggtgaattattgtcactgtcggataaaataaattcggtttgttgatcgtctgcaaatgctttttcttccttaggaagtgtgacaatgaattcacttccacttcccggctcgcttttcacttggatatttccgtgatgtaattctattaattcgcgtactagtgaaagcccaatgccggatgagggctgcaggatattgtattgtgccagtgtttcaaatcgataaaatagggattgttgcttttcgggagcaatgccaatgccttcatcagatacggagatggtgacttgctccgaacctgttatcatatttaccgttactttcttcccgttcggtgtatatttgaaggcatttgaaagtagattgaagaatatcttttcaaatttgtcacggtctacccatgcgtatattttgtctgtattagtttgaagttggaaatcaattctcttttcttttgctataaggtggaagctttccattatcttctgtaattgggaaacgagttctgtcttttctaccaacactttcatcttcttattttggattttgcggaaatccagtagttgattaaccagacgaagcatacgttctgtgtttttatgtaccaaatttagatgttcccgaactgtcggagagattgcttcatgcgctagaatttctgatacagggctggatattaaagttaaaggagtgcgtaattcatgtgaaatatcagtgaagaaacgcagtttgatattggataaatgttgttccagatcaacctgatgccgcaaacggtagatatagaacaggatgtatacaatgatagtggtgaataaaacgaacatgacaatatagaataaccatgcccagtatgtttcccaaaaagtgggtaaaacatgaatggggagagtgcgtatattatcggtccatactccgtcgctattgctggaacggatttgcagttgatattctccggcaggtaaatttatgtatgttgcagagcggttattaccggcttcgttccattcttcttccaggccttgcaggcgataggcgtattcgatggcatcgggatttacataatcaatggctgcaaattgaaaggtgacattacgttccgaaggatttagttccagttcttttatgtcatcaagcgctacatgaagttgacttccttgtattttgagtccggtaaatacaataggaggtacataagaactttttttcatttgttctgtgttgatttcaagtatcccttgattggttccgagaacgattttcttttgactggttagtgtgggaactgcttcagtgagattcagttctctctgaaagtaattacttccataattctcaaatgttccttgttgtggattgaatttggatatggagttttcggagattacccataattgtttttgagtatcttcgagcattgaaagtaccaaatcggaagctaatccgtctttgattgtataacttttgaattgtatatcttccgtgagcagatttttagagataacctggctgattcctccggtgaatgttattacataagtgttttttcgactgtcagtaaatatctgcatgacatcattactgctaaggctggaatctacattagggatacggttgctgtgatagaacttaatttcttcaggctgatcgaacttattggagaatgtaagtaaaccattggttgtgccaatcaataacactccgttgggggcttctgcgatatgtcttattttgagtgaagtagaaacaggatagtttttcagccggttgccgctatggataaagttggtagaaccatcaggtgcgtgtgataataggttgaggccacctccataacatgcgatccatatattgtcatgactatcctgaataatactatagacactattgttgcttaaactgtatgtatcttgtggctgatggacgaattgttgtaaaagataggagtgctcatttttcttctttagaaggatgaggccgtcttttttggttcccatccatatatttccttgtttatcttccataaaacagtacacactttttccgaaagtaacctcttgaggggtgattatgccctgtggagaaaggtagccttctaatgtcccatccggacggtaaattctgacgtttccctttttggaagcaacccagagacgtttctgtttgtcggcaagaaaagcacgtatttccaatccattgtctatgggacgtattctgtatttattgggatagaaagatattttgtctacgccccggtcattggtaatccatacattctgttgccggtcggtataataatagcgaatagagggggcaaatagggaagcgggattattttcatctgcaaagtatagtttcagttgattactgtcgcggtcataatagcacaaatgccctttttgaggactcatccatagtgtgccttcatggtcttcaaagatcatgtaccggttgtcgcgttcatattggattaggttttgtataggagctgtgaagtgctgcttatctcctgttttcagatttagctttatcacaccggaggtattggcaaagatccagacttctccggttttgtcctgataaaagaaatgagcttcattggatggctgggtggctgtttgtatattaaaatgttggaattttttcttttctgtatcgtatgttataaatccgttgtcagttcctaagccgatcttgtcattagaaggggaaatggaagatatggaatagatatctgtgacaggacatggtaactcctggaattttatatttccgttcttgggatcatatattgcgatttttccggaagttgagataagatatattctcttattatattctttgaccattttgaacggataatcgctgttgattcgttttttcccgatgatggttactcccttatctgtcatgatccattcgtccccgtcggaatcttcgtaaatgtcgaatatcttgtttccttttaaattttggttgaaactgctgtataaaatgatatcttttccttctttgcaggtttgctcattgattctgaaagcataaccttgttcgcaggtgatccatgtaatccctttatttaaggtatagatattgctgactgtgttggtctgttgcagggatgattcaataggaaggagtatgtcaataaacttctctgtctgaatatcaaatagatatgcacggttatcataagatttgcaccatatatctccgtctttgctttctgtaatataagagaaacggttagtcgttaaagtacagccgtctcccggaaatgctttgtaatttttaaatgtgtatccgtcgaatttgttcagtccattccaggtggcgaaccaaagaaatccttttttgtcttgcattatattcactactactccttgcgaaaggccactattgacagagaagtgtttaatctggcaaagaggttgagctgctacagtcagactggtgtataagcataaaaggaaaacatagagtgtcttcatgatattataaattatgtgtagagcaaaaatagataaaactggattaaaaaggaaatataaaaccgtgattgaacataaaatgcacgcttttgcatatttaatccacctgtctatcctctatcaagcacaattattaccctataaggagagaagatacctcgtacttttgttttgacaattagaactggtaaaattttaaatgaaaactataaatgaaacgtctatttatttgtgtagtgggacttgttatagccgtaaccgcatggtctcgtacctttaatatgaaggagcttggagctgatccccgaggtattgaatcttgtacggagttaataaaccaaacgattgaaaaagcatcttctgaaggtggaggaactatttatttcccggcaggtgtttatttgacagccactatccacatgaaaagtaatataactttgtatgtggagtccggagctgttcttcgtttttcagatcgttttgaagattatcttccttttgtgaagattcgttgggaaggtacagtgatgaatactttgtctcccctgatttatgcgcatgatgcggagaatttgactataaccgggcgtggaacgttgaacggtaatggattcaaatggtggagctgggagaaagaaacacgggagctgattaaaaagaacggaggaaaattgcctgctttgaataaactacaacgaatgtgggaagaggctaatgaagatctggaaatttcggattattataaaccttctttagagcgtcgtatgtttcggcctccttttattcagttttatgaatgtaacaatgtgttgatagagaatgtgaaaattgtcaattctcctttttggaccataaatccggctttttgtgataatgtaacagtgcatggagtgacgatatataacccttcaaaagacccaaaaggtcccaatacggatggaataaacccttcttcttgccggaatgtgcgtatttctgattgttttattagtgtgggggatgattgtattacaattaaatcggggcgtgatgctgatggacggaaatatggaaaggcatgtgaaaatataacgataactaattgtgttatgctttccggtcatggaggggtagttattggtagtgaaatgtcaggcggtgtaaggagagtgacaatttctaattgtgttttcgatggtacggattccggtattcgcttgaaatcttctcgtgggagaggaggagttgttgaagagcttcgggtagataatatcgtcatgaagaatattcagcggaatgccttcatctttgatttgttctatgataaagaatcaaaagtggaacctgtcagtgaacggactcctgttttccggaacattcatttgagtaatatcacaggttctgatatcaagcaaattggttatattaaagggattgaagaaatgcctgtacaaggtttgtccttttcaaatattaatatgaaggcagaggttggatttatagttgatattgctgaggatattcgttttgataatgtggatttctcttcgcagactggttcaccgtggcaattcagtaagtgtaagcagattgttctgaataatgttagatcgaagtatcctgtaaaccaacaaccgattgttacttttgaagatgtcgataatgctattattaataattgttttcagatgactcctgtgaaggatttttataaagctaataacagtcatattattgaaggacataattattggaaaaaagagagttttaaataaacaggaactatcatattatttctgttgaattttattgttgggtagatatgagaagaacgatattacatcatctgtaatatcgttcttctattgattagagttgtttataatttacttcttatcgttttcgcgaatctccacccggcggatcttaccgctgattgtcttaggaagctcttctacaaactcgatcacacgcggatatttataaggagcagtcactttcttcacgtggttctgcaattccttaatcagttcttctccggcacgtgctttatagtctttggatagaacaatcgtagcttttactacctgaccgcgaatctcgtcgggtactccggtaatggcacattccacaacagccggatgagtcatcaacgcactttccacttcgaatgggccgatgcggtaaccggaactcttgataacgtcgtctgcacgaccgacaaaccacaggtatccgtcttcatctttccaggcaacatcgccggtgtaataaataccatcgtgccaagcttcatgagtacgttccgcatcccggtagtattctttgaaaagtccgagaggtttacctttgctggtgcggattacaatttgtccttgttcacccgcttcaacagagcgaccttcatggttgatcaagtctacatcatattgaggattcggcagccccatgcttcccggtttcggttccatccaaggcatggtggcgatggtgagggttgtttctgtttgtccgaaaccttccatcagtttgatacccgtcagcttcttgaaagtttcaaatacggcagggttcaatgcctctccggcaatggtgcaatatttaagtgaagacaagtcgtactttgtcaggtcttcgtgaatcaagaaccggaagatggtaggaggtgcacagagagaggtgacatgatattcctggattttttccagaatagctgccggggtaaacttctcgtggtcgtagacgaagatattggctccggcaatccactgtccgtagagttttccccatactgcttttccccagccggtatcggcaatggtgaggtgaaggctattttcatccaagttgtgccaaaaactaccggtaacgatatgacctaacggataagtaaagtcatgtgccaccatcttaggttcgccggtagtgccggaagtaaaatacatcagagagatgtcatcattagtattcgcatggcgcggacgtacaaacggagcagcattttcgataccctgatggaaatcttcgaagccttccgggatttccggaccgacactgactaacttttcaaccgtgggacattcgggaagagcctctttgatatgttgcaggatgattccttcgccggcagctacgatcattttgatgtcggcagcattgcagcgatagataatatccttcttggtcagcaagtgagtagccggaatgacagttgctcctagtttgtgaagagcgatggtgctataccagaactcataacggcgtttcagaatcagcatcaccatgtcgccacggccgatacccaggctctggaagtaagaagcggtcatgtccgtagatcgtttcatgtcggcaaatgagaattggcgactttcgcctttgtcatttgtccaaagtaaagcgttcttgtcaggttgttcggctgcccaggcatctactacgtcataaccgaagttgaagttctccgggacgtttattttcaaattcttgttgaagtcctcttgtgagctgaaagaggtctgtgataaaaatctttctaccatgatgttgttacataattactgccagaaaacgtaccgttttgccatcgagcgctttcatgccatgtggaagtttagagttaaaataaatactgtctccttgattgaggatgatttctttgccttcgatgttgataagcatacgtccttcgatgacaaggttgaattcctgtccattatgtttgttataatggatcggctcgtcgattgctttcggttcaacggtaacgatgaacggatcggcggtacggttcatgaatcctgaagccagtgactggtatttataagctttggtacgttcaatgctgatacctttgccggcacgagtcacaaagtagctgctcattttaggttcttcgccaaacatcagagcgtcgagggctacattatacgtacgggctattttttgtaacatgctgacagagatgtcgtaatctcctgtttccgcaagccggtattcttcagcagaaatgtcactatcgcgggcgatatcctctgcggtcagttccaatacatcacgtaatccgcggaggcgttctgctatctgtttaatttgttcattcatacaaatggttagtattttatgattaataattctatggtgttatttggaagctttcatggctttgataatagcagaggtgaagccgttgtgttctaattcattgatacccttgatggtgattccgcccggagtggttactttgtcgatttctacgctggggtgggtgtcgttgttctgaatcagtgcggccgctccttttaaggattgggctatcatctgcatggcatctttagggcggagtcccatttcgattccggcttgcatggctgcctgaatgtatttcagtacgtaagcgataccgcaggatgccaatgcggtggctgccgctattttatcttcggggataagcatcactgttcccatctcgctaaataaccggaggatgaagttgtcttgttcatcattcgtgttgcgcgcggcaacaagcgtcatgctttccagttcgctgatagcggtgttcggaatcagacggaacatgggcatttccggtgctacgacataatgagccagttcttcaaaactgatgccggcagctacggagatgagtatctgtttgctttttaatttcaactcgcgcatcaccgattccataaaccacggtttgacggcaaggatgacaatgtctgctcctgtggctgcttccagattattgttggtggtggagatacccggaaattcttttttcagtttctctagttttccggcactgggattggatacaatgatatccgaatcgtctatcagacttccttttgccaggccacgggctattgaaccgcccatgtttcctgcaccgataatggctattttcatatacgcttgtttttaatgagttgttacagacaaaggtaacagttaattacgaaaaaacaaaaagcagccagaataagaaataaatttctaataaaggctgcttttatcgttggctgtttattaatcaaatgagcggttagagtacttttttgaaccgggcgaggaactctttcgcttcctccatgctgagacagagaggaggtaacaggcgaagtacattcgtgccgcttgctccggtaaatacatgctcgtcatagatgagacggctgcgtagttccttgatcggttcttcaaattcgaggccgatcattagtccgcgtccgcgcacttctttgatttgcgggaattttttcagctcttccagtaagtaatcacctactgccttagcattttctaccagattttcctgttcaatgacatccatcacagcgagagctgccgaacatgccaggtgatttcctccaaaagtagttcccaactggccatataccggtttaaacatcgggctgattaagacacctgccattggaaagccgttaccgattcctttggctacagtgatgatatccggcttaatgtcattatattgatgagcgaagaatttaccgctacgcccgtatccgctctgaatttcatcgagaatcaggatcgttcctgtttcgctgcaagctttgcggagttcctgcataaattcggtggttggtatcttgataccgcctacaccttgtattccttcaatgataacagcgcatgtgtctcctttagacaattcctgtttcatcgcttccacatcgttgagtgggagataggtgacatgaccgttattgttgataggagcgataatagaaggattgtgagtcgcttctactgcaagagacgtccgtccgtggaatgctttattgaaagatacaatcttagtacgtccgttgtggaaagaagcaagtttcagagcattctcgtttgcttcggcaccactgttaatcagaaacaggctgtagtcttcgtaaccggaaatctttcctagtcgttcggctacctcttgttggagcttattgataacggagtttgagtagaaaccaagtttagccacctgattactgatcatcgctacatagtggggatgtgcatgtccgatggagataacggcatggcctccgtagaggtccagatattccgttccgtttttatcccatactttacagccatcacctttgacaatgttgatattgtataaaggatatacgtcgaataaattcataattcttctgtttttaaaaagctgaaggcttcaaacgtagtcctacggtttcttccagattgaacatcaggttcatattatgaacggcttgtccactggcgcctttcagcaaattgtcgatacaagagataatcaatagcttatcaccatgtttttccagatgtatcaggcacttattagtattaacgacttgtttcaagtcaatattcttgtctacgatgtgtacaaaggagtcttttgcataatattcctcatacatacgaacgatttcttccagcgctactttggtcttgactaccagcgtcgcgaagataccacgagcgaaatctccacggtacggaataaagtcgatgtccgaatcgaagctgttttgcaactgtttcagcgattgcttgatttccggaacgtgttggtggtcgaatgctttgtacacactcatattgttgtttctccaactgaaatgactggtagcacccggtttcaccccggctcccgtacttcctgtaatagcatttaccattacatcatcagtcagcatcagattcttggcaagcggaagcaaaccaagctggatgcaggttgcaaaacagccggggttggctacgtgcttcgccgtacaagtggcacgacggttcagttccggcagaccgtagataaagtcgtggtcgtcacttttgatacggtagtccatggagaggtcgataatcttcaggttttccggtatgttgtgactttccatgaatttctttgtatctccgtgggcggtacagaagaaaagaacgtcgatttcgtccagaggtaactggtcggtgaacgttaaatccgtttcgccatacaggccttcgtgaacgtcggtaattctgtttccggcattactgctgctgttgataaatacgatttcagtttccggatggttgagcagcagacggattaactcgcctgcagtatatcctgcgccaccaatgattcctgctttaatcatatctcttcgtctttgtggttattatagtaaacacgtagcggagtagaagtcactttgataaagccttttgcgtcttcggctgtccagcctttctgcatttcaccgtattctccgaatttagtcttcaccagatcatcttccgattctacacctacggtagagaaggaaagagggcgaagctcgaggatagctgtaccgtttacgttgcgctggctttcctgcaacatggcttcgatgtcacgcatcaccggctccaggtattgactttcgtggaggaacataccgtaccagttagctacttgatccttccaatattgttgccatttgcttaatgtatatttctcaaggaaacggtgagcgccgataatcaacatcggggcggctgcttcgaatcctacacggcctttgataccgataattgtatcgcctacgtgcatatcacggccgataccgtatgctgcgccaatctcttccactttctggatggctttgatcgggtcgtcaaacttctcgtcgttgacagctttcagttcccctttttcgaaagtcaggcggagctgttcgctaccttctttttcaacgtgcttgaggtaagctgtttccgggagtccttgcgcggagtcgaggatttcgccaccacagatagaagtaccccataagcctacgttataagagtatttcagtttggtgaagtctgcactgaaaccatgcttgttcagatagtcgatttcttcctgacggctcaatgccatatcacgggttaatgtgatgatttccacattgggagccagtacgaggaaagtcatatcgaaacgaatctggtcgttacctgcgccggtagaaccatgtgcaatggcgtctgcaccaatttcgttagcatagcgtgcgatagccaatgcctggaaaatacgttcggaactaaccgaaataggataagtaccattacgcagcacatttccgaaaaccatgtatttcaggctcttttcgtagtattcctgggtaacgtctattgttacatatttcgtagctcccagtttataagcattttcttcgtttgttttcagttgttcttcactgaaaccacccgtattggcacaagctgcatatacttcgtaacctttttctttggcgaggtacatgacggtgaacgatgtgtccagtccgccgctgaatgccaccactacttttttcttcttttcttccatagtgctgtatcttttaaatgttatttctttcttgttcttttttgatgttccgcggctctgtcggatcgtatagcatggctgtacagatgcagaacttgcggtttttcgctaccaggatatcatggttgatacatccttcgcatcctttccagaaagcttcgtcgtctgtcagttcgttgaaggtgacaggcacataacccagttcggtattcatcttcatgacggctgcaccagaggtcagactgaatattttagctttcggccatcggagacgtgccagttggaaagaagcttgtttgatacgtttggccagtcctaatccacggaaatcgggatgaacgatcagaccggaagtagccacgtattgtttgtttccccatgattctatataggtgaatccggcgaaagtgtcaccacaaagagcaataatcgccttaccttctttcatctttgtcgctacgtattcgtgtgtgcgttccgcaattcctgttcctcgtacggcggcagcatttctgatagtttccaaaatagtgtcaacgtaaacctcatgtgaggcgtcggctaccataacatctatttgttgagtgtccatttctttattatataataataggtataattattcgatattgggaatgatgagtgacaaaagctgacgtattttactggttgcaactccttcacgcaacaccaacatgatcgtatcgtcaccggcaatggttcccagaatttcactgaattcattgttgtcgatgtcataagccatgctgctggcataaccgggacgggtgcggataacggcgatgttaccggaaaactgcaaagagataaatccgttgttgcgtaacatttcaccggcactctggtcggtagaacgtttatacataatgttgttcggcagtacatatacgtactttccattcatactggcagccttggctactttcaattgtttcaagtcgcgggaaagggtggcctgtgtcagttcgaagccttcgcggttcagctcttgcagcagttcttcctgcgaaccgacctccttgcttgagataatcattttgatggcgtctaaccgatttgctttcttcttcattgtataattattctaagaatggcgcaaaagtatgcattattttggagaaaagatgcataaaaccaaagtttttttgcataaaagtgaaaatactttagaaagggatagtgatataatcaggatatatgtgggtatatgtaacaaagttgtttctttattgcttcattttgtgctgactttttttattgtctattaaaaaagatgcaattgtttgtttagggatttttaaatatataaatttgtaaagtgaataaggagacaaatcgtatgatagatgaagatattgagctttattctctttttagaaaaggagatagaaaggcttttgatactttatttttgaagtattattccatactatgtgccttcgggaagtactatattcctatagaagatgctgaagaagttgttttggatatcatgacatggctatgggaaaacagagaattccagatcatagaaacttctttgcgaagttatttgtttatggcggtcagaaacagatgcttggatttaataagtaagaatcagacaaaaagacgttgttatgagcatatgtttgctaaagaaatgcagacaagttttgaagatcctgatttttatgtagtggaggaattgatggcgaaaatagaaaaggccgtgatgcgattgccggactcctatcgtataacttttgagatgagccgttatcaagataaaacatataaagagattgcgaaagaattaaacgtttccataaaattagtggagtatcgtatccagcaagcattgagacttttacgtgtagaactaaaagactatttaccgttgattacaatcatattcccttattttctctaaggatagccgattcgtttttgagtcttaaaataaaaatgcagcttttaattaaaaaagttgcatttttgtttaggggctaattgaagtattccgtcttcttaataaaatgaacataaaagatgatggaattacatgaaaatatagatgaggctcttttactcctttatttttccggtacactaggagagaaagaaaaagaagaggtagaaaattggatttccctctctgaagagaacagaaaaatagctaaacagatttgttacatacaccacgtaacagatataatagataccgtgaagcagatagatcctaaacaggcattggtgaagctggataagagattgtcaaaaaggaagaaaataaactggtgggaatgggggataagagcagcagctgtgttatttattcctttattcttatctttcttctattttgtatttaatcaagataaaaattatgatcgttatgtcgaaattcggtctaatccggggatgatgacaaaagtggagttaccggatggtacttgggtatggctgaattctgcttcttatctaaaatatccagtgtcttttgaaggagaatatcgaaaggttgaattgctcggagaagcttatttttcagtacaaaaggataatggacggaaattcttagtcgatgtaggaaaggggattgaattagaggttttaggtactgaatttaacgtggatgcttatccggatgataagtttgtagctgctactttggtgacaggtagagtaaaattccattgtcagcagaaaggcagggaggttacttatagtatgcaacccggacagaaggtgatttataatttattggatgagaaacttttgtgtacaactacttttgttgaatctgatattgcttggaaaagtggaaggatcatttatcgagatactcctcttgaagatgctttaagaactttgagcaagcgttttgacgtagagttccgtattgttaatccattattaaagaaatattgctttacaggtacttttattaatcaacgtctggataagatcttggaacacttcaaaatagcttcaggggtgagatacagatatcttgaatcggcattggacaacggtgttgtgaaagagaaaacaataatagaaatttattaaacaaaaaagaactatgaaaacactccctccttaaacaaaaaatatgggaaaaatatagcactattcttcccatataaaaaatcatttagccttacttgtttgccgacaagtgtagttaactttatttttaatttaaatcacaacaaatttatgcaaaaacattgtagtatccaaattcttgggattaaaaggctactgaaagcaactttaaaaggaattccattgcctatgagattattaattattatgctatgtgtttcgataggatgcattcgtgcgacaaatacttatgcgcaaaatgcgatccttgacttgaaagtcaataatcaaacgattgaaaccgtcttgaaaataatagaatcgcggactgactttgtattcttctttaacagtcagcaggttaatgtacataaacgtgtctctattaatgtcaataaacagaatatttttaaaattctagatgaggtttttaagggaagtgacgttgtttattcagtgcttgataaaagcataattttgtctagtaaaagatttgcgcctgatggaaatttgaagaagattacaggtaaggtcgttgatacgaacggtgaaccgttgattggtgttacaattgctctgaaaggaagcaatagaggaacggtgagtgatgtaaacggaaatttttctttaaacggagaagaaggaaagcttaatgtgttgaatatctcatatattggttataaagaccaacaggtaaaagttgaggatggtaaaactttgattattacattggaagaggataccaaggttttggaagaagtagttgttgtgggatatggtacacagaaaaaaatcaatttgacgggtgctgttgctgtggttgacgataaacaagtaatcggacgttcggccgataatttgtctaaactacttcaaggagctgttcctaatatgaatgttactgtttctaacggtcgtccgggacagggtggtagcataaatattcgtggtatcaattctatcagtagtagtgccacgcctttgatattagttgatggtgtagaaggtactatcgatgcagtgaatcccaatgatgtggagtctattagtgtattgaaagatgcttcttctgctgctgtatatggggctcgtgcagcttatggagtaattttggttacaacaaaatctggtaatgatgataaaacacgtgtttcttataacggacgttatagctttggctcacctacagtttccagagattttgagactcgcggttattattcggcggctatcaatgatatgttttattctacctatcaaggttctaactatacgaattataatgatgaagattattatgaaatgtggatccggcgtaatgataaaacggaaaatccggaacgaccgtgggtggttatcaaagatggtgaatataaatattatggtaactttgattggtataactacttcatggatgagtctcgtcctacatgggaacacaatattagtgtcagtggtggcaataagaaagtgcactatttcctttccggtgcttattatgatcagaaaggagttattcggaaaaatatggatagtttcactaaatacaatttccgttccaaggtaagtattgagattgctccatggttgaagataagtaataatacgtcatacaaaaaggattcttatccatttccggggccaggtgctattaacaatctttttgatgcgataagtaagcatgccttagcttctattgttccaatcaatccggatggtacatatatggggaatgcaacagttattacaggaggatatcgccctgctaatgatcttagtgcaattcttgaatacggtaaacacaagaatgaggatactaattacttttttaataccacctttgaggcggtaatgacacctgttaagaatgtaacggtgacggctaattattcgtttgctcaacatgaatatacggcaatgaatcgtagtgctaattatccatattcacgtgtacccggagaagttctttggaaaacagatggttatggccttaatactctttatgaacgttctaatcatgattggtttcattcatacaatatttatggaaattatacaaatacatttgccgatgtgcaccatgtaagtgcaactgccggtgtcaattatgaaactaaattttttaaagacatcaaaatacaacgtaatgatttattgtccgaagatttaactgattttaatttagctaatggtgatgaaatgagtattgcgggtggtaaaaatagatatgctcttttcggtcttttttatcgtttgaattatgactataaaaatagatatttatttgaatttagcggacgctatgatggtagttcacggtttgcccggggacatcgctatggcttttttccttcagtttctgccgggtggagaattaatgaagaaaagttctttgcaccattacgtaaacaaattagtaatttgaaattacgcttttctttgggagcattaggaaaccaacaagtcggatattatgactatttgcagactatatcttctggtggtacaatttcttatgcttttggtgataaaaataaagcgtcaggtgctagtatctctgctccgaatgcttctgatttcacttgggaaacggttgttacaaaaaatatcggtttggatctcggactattgaataatcgtttgaatatgacggctgatatatatgtacgtgatacgaaagatatgttgatggcttccaaggatcttccgaatgtatatggtgcttcttctccaaaaacaaatgctgctaacttacgtacgaaaggttgggaagcatcgattagttggaatgattcttttaatctaaagggaaaagcgttccattattctgtcgtactaggcttggctgataatacgactaaagtgacaaagtataacaatgataacaaaacattgggcactccatatgaaggacaacaactgggagagatttggggatatgttgttgatggtctcttcaaaactgatgaagaagctgaaaactatccggtaaatcagagttacgtaaataatatattgaatatttctgtaaaatctcaaggtctccatgcgggggatgtgaaatatgtggacttggatggcgataatattatttctcctactttatcggcaaacgatgtgaaggatcagaaagtgattggaaattctttaccaagatatacatattctgtcagattagctgcagattggaatggaattgatttttctgctttgttgcaaggcgtcggtcgccaacattggtatcccaatggtgaaactagtctgttctggggtccctatgcccgtccttattgtacttttattccgaaggatttcttgacagatgtttggtcagaagataatccggatgcttatttcccacgtccgagaggctatgtggcattggatgttaatccacgtgagttgtctaaacctaatactcgctatttgcaaaatgtggcttattgccgtcttaaaaatgtaacagtcggttactctttgccacgtacttggctaaaggctttgcatatggaacgtgtcagggtttattttagtggagagaatctttttacattcagccctttacatagtaattatattgatccggaacatgctggggcttctacgagctggaaaagtggtcatacgaacgtgacttcttatccaatgagtaagacctattcatttggaattgatgtgactttttaatggaaaataaaaactaggataatatgagtagtataaaatataaaatatggatgctcttgcctctgatggcaatgatttcttgtgaaagtattttggataaatttccggaagataaaattacaccggaaacattctttacaacagaaaacgagttagaattgtattcaaacaatttctatgtcgcttgtatttcgggtacaggagtgtttaaagattacggtgatgtaattattcagcctatcttggaaaaagcgattagcgggcaacgcactatacctgaaacagattctaatttcgatggttggggttggggagcccttcgtgatattaatttctgcctggagaacatttatcgttgccagaatgaggaagtacggaatcattatgaaggtttggcacgtttttttagagcttatttttattttgtaaaggtgaggcgttttggagatgtgccatggtatgattatgtgattggaagtgctgatacggaagctttgagtaaacctagagattctcgtgagtttgtaatggggaaagtattggaggacattgatttcgcgattgataatttgagaaaacaaaaagatgtataccgggtgactcgttggactgctttggctttaaaatccagaatttgtttgtttgaaggtacatttcgaaagtatcatggtttgaatgattgggaaaagtatcttcgtgaatgtgcatccgcatcggatatctttatcaatgagagtggttatacagtttatacggcaggttctaccccttatttcaatttatttggctctttgaatgctgaacccacggaaataatcctggcgaaagattacaatgcagctttgggattgactaatattgtacaggcattttgcaattctcctggtgaggcaaattcaggtgtgacaaagcgttttgttaattcttatctgatgaaagatggttctcgttttacagataagagtaattatgagactattggatttgtggaagagatgaaaaaccgtgatccgcgtctgacacaaacgattcgtgcagcaggatatgtacgtgatgacgggaaaaaatatctgccaaactttaagttggcaaaattagggtatcatctgaagaagtacgattgtggagttaaatatgatatgtcttctgaatctgatttgccattgtttcgtacagccgaagtttatttgaattgtgcggaagcaaaagcagaattggggacattgactcaggatgatttgaataaaacaattaataagctaagggctcgtgtaaatatgccgaatttattaatggcaacagcaaatgctaatccggacccttatttgaaggagtggtatccgcacgtggaaagtgacgataatcaggggattatccttgaaattagacgtgaacgcgctatagaactggtaatggaaggctttagatattatgatatcatgcgttggaaggaaggtaaaatatttgaaaaaccatttcttggtatttattttcccggtccgggtgaatatgatttggacggtgatggaacgaatgatgtttatctgtatttgagtactgataaaggaaactcttcttgtgtagatcagtttgagataggtggtgaacttagcttggatcatgagacaagtggtaatttgattattcatcaaagtatcaaaagagtatggaatgaggacaaggattacttgtacccgataccaacaaaggatcgtgttttaacaaatggagcattaacgcagaacccgggttggaatgatggacttattttttaattttaaatggagaaaataatgaaaatgaaatatttatatatgtcttttctattggcgttagtctatagttgtagtgactctggagataattcagattatagcgaaatgttgaaaaaagatttcaaccaagaaattaaatgggatgtggattcattggctcttatgagagcatcttgggaaaaaacggatttaggtaacggggcagctgtttgtacggcacaagcgagcatgtgggggactacccaaagcgtttcttatgtggtatatccgacgactatgttttctaccagagttgctgtatgtgatactcctgccaaaactagtatgattgctaaagataaaaaagcattgtttgctatcaatggcagttattctatttccggaaatccgtctacatttactatggtggataaggtggtgaaggttgcgtctacgatcgaatctgccagtaaagtgaacggagtgattgctattgatgcggaaggttctgtagatgtgaagtcttgtacgttttcagattatacggatgtggaagatgaatatgaatcagctttagcatcaggtccaatgttacttatggaagggaaagtgtgttcgtttcctcaagatgctatttatacacaacgtatggctcggtctgtgattgggataactgctcagggaaaaatgatgctgcttactattgatggtgctataacgggaaatgctgatggtgcaacacttgaggaggcagcttttattgccaaaacattggggatgaagaatgcggtttgtttggctgacggaagttcttccacgctatggacatcaggtaaaggcgtagtgaatcatccggttggaaatggacagtatgatcatgaaggcgaaggtacagtgtctactgtgatctatgttgcagcttcttctttatttgacggtggtgatggaacggttgataatccttatttgattagcaataggaatcatatgaggaacatgatgtctgttgtagaacttgataaaacttattatttcgaaatgacgaatgatgttgatatgactggcattgactggaaaccgctgaatacgggtgagcctgttgaccgttttgatataaagattcattttgatggtaagggacatacgattagaaatttacattgtgagatcagttctcggtacgccagtttctttggggtaatgaatggttcatgtcgtaatgtgcgctttgaaaatgcggaagttattggatatggttcttcttgtacgggtattgttgccggttatttgggaacaaatgctttggagtgtttgattgaaaatgtatatgtgtctggtactgtaagtggcatacagcaagtgggtggtattggtggcatttttgctaaaggtactgtacggaattgttatgcagatgtaaaagtaatcggggcttctcgtgccggtggtattgttgctgaaccaaggaatgctgtagttgttgaaaactgttttgcgacaggaactctttatagtacaggaaatgcaggtggtattgccggaggacttaatggcaataatcctacaataaaaggttgtatcgcttggaatgaacagattgatggtgaacctgtatcaggacgtgttattggatggcagtcaaatacctatacgaaggctacggattgttatgcgaaaaaagatatgattatcgcatggggacccaacaaaggtatgacgggggccgatgctaatactgccggaacttatgattggggtaacaataaaactgcaatttgccatggtattactacggaaaatagtgtagatgctgctaagaaaataggttggtctacagatatatgggatctttcaggcgtaactccattattgaaatcttttaatgataagtaatgatacgaatagggaatctatatgtttatttaaaaaattatattatgaagtttacgaagttaacaattgcttttttatccgtatttttttgtctagttgtcgcttgtggaagtgatgggatcaatgatgaccccaaaacaccggatgttacagagccggtaacaccaaatgaaccggacgaaccggacaacccttccgttgtaaaagttccgactctacagaagaatgtccaagatgaatggaaaattgattctatcgatgatggttttatttattataactatgaacggtatgacgatgtgagtaaggctcaacagattgtaaatgtgctggaaattgatttactttccaataagtacaaagttgaatttacatataataatggagattctctttcaactacagcacaagtacgtggggctattggtggtattaatggtgggtatgaacaggaagctatttatattcgtatcaatggaactaatatctctgaagtgacactaccggagggacatttacgatactggaaacatgatggtgcgctttattcggatggaaaatctgatattggaattatatatggcggcagaaatggaaaggctgcaattgatacatataaacaacattctgcaaagtatttgttagctagtgcccccacactgattgacgattacaatccgttaggtgaaacttttgttggtaattatactatggaacaattggagtcttttgactatgaagattatcgcagacatcaaggagtacgtcatcctcgtacggtggttgctgtgacagaggataaagatttgttgttagtcactattgatgggcgctgggctggtaaggcggaaggtatgagcgcaaaagaagtaaccttattcctcaaaaagcatttcaatcctcaatatgcacttaatatggatggtggtggatctactactatgtatgtgaaggggaaaggagcggcaaaaacagatgttgtcaattatcctactgataatggagtctttaaccactatggacaacgtcgtgtaacaactcatattatagtaaaaagaaagtagatcttaatcatttcatcataaaataggtattttatatattgtaaacggtataaatccatttagcaaagatggctttataccgtttattagtacctatacagaggtgtagggaaaatgtgaatctgtttatatttgcaattgtattgtgtcttttgtcttttgtgtcaaaatgtataccctttcaatcaaaatacataaggaaaaggaggagggaatcgcctatctttgccatgtaggtaaatggataccttaaatatatagacagaataccatgaaacaaaacttttttgcagtcgacctgggcgcaacgagcggccgtacaatcttaggaactttcattgaaggcggattaaatctggaagagattaatcgctttcctaaccacctggttgaagtaggtggacatttctattgggatatttatgcattatatcgtcatattcttgacgggttgaagttggttgctcaccgtggagagtccattgcttctatcggtatcgatacctggggagtggattttgtatgtgtcggaaaagacggtaacttgcttcgccagccttatgcatatcgtgacccgcatacagtaggagcaccggaggctcttttctcccgtatttcccgtagcaaagtgtatggtaaaacgggtattcagattatgaattttaattcacttttccaattagatactttacgtcgcaatcacgacagtgcgttggaggcggcagataaaattctgtttatgccggatgcgttgagttatatgcttaccggagagatggtgacggaatatacgattgcttcgacagcccagctggtgaatgcacagacacgacgtttggagccggagttgctgaaagcggtaggattgagtgagaagaatttcggccgttttgtattcccgggtgaaaaggtgggagtattgacggaagaagtgcaaaagataaccggactgggtgcaattcctgtgattgcggtagccggccatgataccgcttctgctgttgctgccgttccggcattggatcgcaactttgcttatttgagtagcggaacctggtcactgatgggagttgaaacggatgctccggtgattaatgccgaaacggaagcgttgaactttaccaatgaaggtggtgtggaaggaactatccgtctattgaagaatatctgtggaatgtggttgctggaacgttgccgtctgaattggggagatacaagttatcctgaattaatcagtgaggcggatgcttgtgaaccgttccgtagtctgattaatccggatgatgactgtttcgcgaatcctgcggacatggaaaaagctattacagaatattgccgggctaccggacagtcggttcccgagaaacgcggacaagtagtgcgttgcatctttgaaagtttggctttgcgttatcgccaggtgttggagagtttgcgttcactttctccccgtccgattgaaacattgcaggtgattggcggaggtagccggaatgatttgctgaaccagtttactgccaatgcgataggaattcctgtggtacccggtccatctgaagcaacagccatcggtaatgtgatgattcaggccatggcggcaggcgaagcgacggatgttgccggtatgcggcagttaattaaccgttctatcccgttgaagacttatcaaccacaagacacggaagcttgggatgcggcttatatccattttaaaaattgcgttcggaaataaatagaacgatcgacagaataatcatttttaaaactaatagaatatcatgaaaaaagaagaactgattcagaaagcgtatgaaattgctgtggaacgttatgcagcagtaggtgtagacaccgaaaaagtattgaaaactatgcaggattttcatctgtcacttcactgctggcaggctgatgacgttgcaggatttgaagtacaggccggttcattgaccggaggtatccaggcaaccggtaattatccgggcaaagctcgtaacattgatgaactgcgtgctgacatcttgaaagctgcttcttatatcccgggtactcatcgtttgaacttgcatgaaatctatggagatttccaaggtaaggtggtagaccgtgaccaagtggaaccggaacatttcaagagttggatagaatggggtaaagaacataacatgaaacttgacttcaactctacttctttctctcatccgaaatcaggtgacttgtcactttctaatcctgatgaaggtatccgtcagttctggattgaacataccaaacgctgtcgtgccgttgcggaagaaatgggtaaggcacagggggatccgtgtatcatgaatctttgggtacatgacggaagcaaggatattacagtaaatcgtatgaaatatcgtgcattgctgaaagattctttggatcagatcttcgctaccgaatataagaatatgaaggattgtatcgaatctaaggtgttcggtatcggtctggaaagctatacagtgggttctaatgacttctatatcggttatggtgcttctcgtaacaagatgattacgctggataccggtcacttccatccgacagaaagtgtagctgataaagtatcttcactgttgctttatgtgcctgaattgatgttgcacgtaagccgtccggttcgttgggattcagaccacgttactatcatggatgatccgacaatggaactgttcagcgaaatcgttcgctgcggtgctttggaccgtgtacattatggtcttgactatttcgacgcatctatcaaccgtattggtgcatacgtaatcggtagtcgtgccgcacagaaatgtatgactcgtgctctgctcgaaccgattgctaagttgcgcgaatacgaagcaaacggacagggattccaacgtctggctttgctcgaagaagaaaaggcgcttccttggaatgcagtttgggatatgttctgcttgaagaacaatgtgcctgttggtgaagatttcatcgcagaaattgaaaagtacgaagccgaagtaacttctaaacgataagttatggaaatcttaatcggcttattgattatagccatcggtagcttttgccagtccagttcttatgtacctatcaaaaaggtaaaagaatggagctgggaaagcttctggttaatacaaggtgtatttgcctggttagtgttcccgttcctgggttcactactgggtgtaccccaagagagcagtttgttcgacttgtggggagcaggaggtgctggaatgagcatcttttatggtatattgtggggagtaggagggttgactttcggactttccatgcgctatttgggtgttgcgctcggacagagtatctcactgggtacttgtgccggtttcggtacccttcttccggctctttttgccggtacaaacttgtttgaaggtaacgggctgattcttttgttgggtgtttgcatcacgttggcaggtattgctattatcgggtatgccggtagcttgcgtgcgcaaaacatgagtgaagaagaaaaacgtgctgccgtaaaagactttgcattgacaaaagggttactggttgcacttttggctggtgtcatgagtgcctgctttgctttgggactggatgcgggaacacctatcaaagaagccgctttggctggtggagtggaaggactttatgccggtcttccggttatctttctggttacgcttggaggcttcctgacaaatgcagcttactgtttgcaacagaatgtagctaataaatcgatgggtgactatgctaaaggaaaagtgtggggcaataatctagtgttctgtgcgttggctggtgtactatggtatatgcagtttttcggattggaaatgggtaagagcttcctcaccgaaagcccggtgttactggctttctcctggtgtattctgatggcattgaatgtaacctttagtaatgtttggggaataattctgaaagaatggaaaggggtgtcaaacaagaccataactgtgctgatagctggtctgatcgtccttatcttctctttagtgttcccaaatttgttttaaaaaaatcaagaacggattacacgggttacgcagtttttttataacttgcggcaaaatccatgtaatccgtgcctaattaaaatatatatataatgaaatcaattttagagaatcgtccggcacttgccaaagaagtaaacaaggtagcagaagttgccggatacttgtggcagaaaggatgggctgaacgtaacggtggtaatatcactgttaatatcacagagtttgtagacgatgaaatccgtcagatgaagccgatcagcgaagtaaaatctattggtgtgactcttccttatctgaaaggctgctatttctactgcaagggaactaataaacgcatgcgtgatttagcccgctggccgatggaaaatggttcggtaatccgtattctggatgactgtgccagctatgtgattattgcggatgaagctgtagccccgacatcggaattgccttctcacttgagcgtacacaatgacctgttgagcaaaaactctccttataaagcatctgtacacacacacccgattgaactgattgccatgacacattgtccgaaatttctggaaaaagatgtggctaccaatctgttgtggagtatgattcctgaaacaaaggcattctgcccgcgtggtttgggtatcattccttataaattacctagctcggtggaattggctgaagctaccatcaaagaattgcaggattacgatgtggtgatgtgggagaaacatggcgtatttgcagtggattgcgatgcgatgcaggcattcgatcagattgatgtactcaataagtcggctctgatttatatcgcagctaaaaatatgggcttcgaaccggatggtatgagtcaggaacagatgaaagaaatgtcagtagctttcaatcttcctaaataagatttatactagtcattgattttaattactttagaaaccgtggcattttctaccctggaaggtgctgcggttaaccctttaaacaaatagataaccatgaatcgtattattttaaacgaaacttcgtacttcggtgccggatgccgtagtgtcattgctgtggaagcagccagacgtggctttaagaaagccttttttgtaacggataaagatcttatcaagtttggtgtggctgccgaaatcattaaagtatttgatgaaaatcagattccttacgaactttatagtgatgtaaaagcgaaccctacgattgcaaatgtacaaaacggtgtggcggcatacaaagcttccggagccgattttatcgttgctttgggcggcggttcttccatcgatactgccaaaggaatcggtattgttgtgaacaatccggattttgcagacgtgaaatctctggaaggggtagccgataccaaacacaaagcggtgcctactttcgcgctgcctactactgctggaacagctgccgaggtaacgatcaattatgtgattattgatgaagatgcccgcaagaaaatggtttgcgtagacccgaacgacattcctgccgtagctatcgtagaccctgaactgatgtactcaatgcccaaaggactgactgcagctaccggtatggatgctttgactcatgccatcgaaagttatatcactccgggtgcttgggtaatgagcgatatgttcgaattgaaagccattgaaatgattgctcaaaacttgaaagcagctgtggataatggtaaagatgtggcagcccgcgaagctatgtcacaggcacaatatattgccggtatgggattctcgaatgtcggtttaggaattgtccactcgatggcgcatccgttaggtgcgttctatgatactcctcatggggtagccaatgccttattgttgccgtatgtgatggaatacaatgctgaatctccagcagctccgaaatatatccatattgcgaaagcaatgggagtggacactaccggaatgagtgaagccgagggagtaaaagcggctgttgaggcagtgaaagcactttctgccagtatcaatataccgcagaaattacatgaaatcaatgtgaaggaagaagatattcctgcactggctgtagctgctttcaatgatgtttgtacaggcggtaatcctcgtcctacttcggtagcagatatcgaagctctatatcgcaaagctttctaaagttagtttttgcggaagttcttttcaccacagattacacagatttacacagattattttctaatcggaagccgatatttaagaattaaatctgtgtaaatctgtgtaatctgtggtgtttttctgaaaataattcctatttttgtccaactcaattgcatgaaaacacactggtatgatcgaggataatagtttaggattagaatttaaatatctgattgtaaatgacatggaccgtaaattcgggctatgggtaaataccgtcggctatcaatccattcctcctgattcaccttatccgttgaaagagcatccttccggttacttctttaatgcagaaaaaggaagagtgcttcgtgagtatcaattggtttatatcaccaagggacgtggtttgttttcatccgattctacctctgaaaagcaagtttgtaaaggtcggttgatggtattgtttcccggacaatggcatacttatcgcccgttgcggcagactggttggacggaatattatatcggtttcgaggggcctatgatagacgccattgttgatgatgcttttttgtcgcaggaacagcaaatactggaaataggccttaatgaagagttagtctcattattctcccgtgctcttgccgtagccgaagcggataagatttccgcgcaacaatatctttccgggattgtgctccacatgatagggatgattctttccgtctccaagaataaggtttttgagatgagtgatgtggatcagaagatcgaacaggcaaaaatcattatgaatgaaaatgtttccggcaatgtggacccggaagagttggctatgcgactcaatattagttattcatggtttcggcgtgtttttaaggagtatacaggttatgctcctgctaaatatttccaggaattgaaacttcgtaaagctaaacaaatgctggtgggaacttcccagtcagtaaaagagatttctttttttctaggtttccagtcaaccgaatattttttctctttcttcaagaaacgtacgggacttactccgttggagtatcgttcgttcgggcgggaagaatgaataggatgaagtccatatctattagttatttggctctgattttgggaatatcataaaaactgttacttttgtggcgaagataatgtgctataaaccatcattcttgatatgcgcggacaaaaactatctaagatccattttcttattctgttatctcttttaggatttatatctcctcttcaatcacaggaatataagttcagaacattgggtgtggaggatggattgtcgcaaataacggtgagcgatatttgccaggatgagaagtcgcgtatatggattgccacactggatggtctgaattgtttcgatggcaatcatatcaaagtctttaatcattttcataacgattccatcagttatggtaatctatatgtcacccagatggtggaggacggccaggggagtctttttctcttgacttctaccggacttttccagttcgaccttgaaacggagaaatattatattcttccggtgccttctccttccactcttgccaaaggaaagctgggagtgtggattgcagaagggggaaaactcttcttgtatgataagaatacccgttccgtgaaacccatgtatgcggaggtacatttgccggacaccgggccgacaatggtagaaggttcggaaggaaatctttgggttgctttgaaagatggcggggtgatgcgtgtggatacttgtggatcgatgtcgctttatttgcccggaatcaaggtgatgaaactgataaaaagtaacgatcagaatatttgggttggttcgcaggatcatggtgttttctgtttttcacctcaaggtgcagtcatacatcattatgattataacgacaagagtgtttacacggtccgggatgatatggcaagagcgttatgtcaggatttggaaggaaatatatgggtaggttacagaagcggattgagtaagattgaggtggctaccgggaaaatatttcattatcaggcggatcctaaccgggtgggggctatgtccaatcgttcggtgacttctctttatacggacaaacaaggaactgtctgggtggggacctattggggcggcgtgaatttcttctcaccggaatatcaacattttgtacattatcatgcttcggataccggattgtcttttccggtggtgggtgctatggcagaagataaatccggaaatatatggatttgcacagaaggtggaggactggatttatatcaaccggaacaaggaacattcaaacattttaatgcgcataccggatatcattttagtacggattatctgaaagatgtcgtttttgatgaggctaataactgcttgtggattgccgctgactttacaaacaaggtcaactgttttcatcttgataactatcggaatgatatatatgacctcgaaccgctcggagaggaaagtgtgggagaagctctgtttgccttggccgacactcctcgtaaattgtatgtaggtacaacatctgcagttgttagtctggataaacagaccttaaaaactgaagtgttgtttcatcaaaaggagttgtttacacataattataacactttgttgcttgattcgaaaaaccggctatggtttgcttccgatgatggttgtgtagcttatgtgattgatgaaggacggtttgaaacgtataggataagtctgaagaagcaggtcagatctcaaaaagagctggtcaatgtcatctatgaagatcgaaagggaaacatttgggtcggaacacatggcaacgggcttttcttgttggataagaaagagcgtttgtttcgtttgcatactcctgaaagcgtattgtcgggagaaaatatcagagtgttgggcgaaactccttccgggaatttattgattggtaccggacatggattgtctgtgttagaacagaaagacgggaaagtgataaacttcaattctaaaacaggatttccgctgactcttgttaataggaaatccatgcatgtatcccgcaatcatgatatttatatgggaggagctaccggactggttgccattcgtgaaagtagcttgtcctatcctccgaaaatatatgatttggagttggctcatttgtatgtcaataataaggagattaccacaggcgatcaaaccggcatcctaaataagtcctttgcctataccgaccggattaaattgaattatttgcagaatgtgttttctatcggtttctcgacagataactttctgcatattggcggtggtgaggtagaataccggttgataggttctaatgacgaatggagtgagaatcgtttggggaatgatattacttatacaaatatatctccgggcgattatgtttttgagatcagattgaagaactttccggaagtaattagatctcttcatataacgatcacaccacctttttatgccacctggtgggcctatacaatttatgtgtgtgtgattctgacgattctattctttgtggtgagagaatatagaattcggctgttcttgaaaacctcgttggattttgaacttcgtgagaaacaatacattgaagaaatgaaccaatccaaactgcgtttcttcactaatatctcacacgaaatcagaacccctattactcttatcctggggcaggttgatctgttgttgaattccggtaagttgtctacgtatgcttattcgaaattactgaatatacataaaaatgccggtaacctgaaatcattgataacggagttgcttgatttccggaaacaggagcagggacttttgaaattgaaagtttctcaatttgatttatattctttactcaaagagcattatgtattgttcaaagaattggcagctaacaggaatatttcgtttgttttgcatgctgactgtgagcaatgcctcgtgtggggagatcgtatgcaattgcagaaagtggttaataacctgctgtcgaatgcttttaaatatacttcagacggtggaagtatcagtatggaattggctgatggagcggatgaatgtatgttttccgtttcagacaatggggcaggaatatccgaggaagattacgtgaagatattcgagcggttctatcaggccgagaatatcggacagtatggaggaacgggtatcgggctggctttaagtcagggaattgtgaaagctcatcagggagatataactgtagaaagccagttggggaaaggttcatgctttaaggtcactctgaagaaaggagatgctcactttgattcttctgtttcccggattgaaccggagcaggataaggaatatatttattattcggaagataaagaactattggttaaggaggtacagacggctcaaagtgagagtgggactactgactgcaagctgttggttattgatgataatgaagaaatcagaaatatccttgtagatatcttttctccattgtacacggttgaaactgcaagtgatggtgaggaagggtatgaaaaagtaaaaatgatgcagcctgatctggttatttcggatattatgatgcccggaatgcccggaacggaattgtgtgccaaaattaagaacaatattgaaacttgtcatatccctgtcgttcttctgactgcccttagtgcgcccgaacgtgagttggaaggattgagaattggagcggatatttatgtggtgaagccgtttaatatgcggcggctggtgatgcaatgcaataatctgattaatacccgcagacttttacagaataaatatgcccatcagctggatagcaaagcggagaagattgcaacgaatgaactcgatcagaggtttatcgaacaagcgacgcaggtagtggaagataatatggaaaatcccgaattcagtgtagatgtcttctcacgtgagatgggggtgggacgtactgtcttattccagaagataaaaggtatcacgggaagtacgccaaataattttatcatgaatctgcgtctgaaaaaagcggcatattttctgcagaattctccggaaatgaatatatcggatattgcttaccggttaggatttggaaatcctcaatacttcaataaatgttttaaagaactttttgatattgctcctacgcaataccgaaaagctcataatacctcctccgaaccctctgtgaagtgattaaaataagtcatctggatttttagactagataaaacgaacaattcgatagggtgcaatatattcaaatgcgatacttttgtggcgttggataatgccagcttgtacttgagttttctttggttaggtgtgtccgcacacactttcatttggtagaccgggtactgtgtaatctttattctaatataataattattgtgtagtattatgaaagacaaatatccatgtagtaaataaaagatagcattttattggagagaatcaatatatttttcccaattaattaagtagtgagtaaaaccttgataattaaccaatttaattttattctagttatgaaaaatttgcagagtaggacaaaagtgcggttgcttcagtcgttccttttgatttccttgagtctctttttccttgtcaatccggcttatgctcaaggcgggtttgcagtgaagggagttattgtggataaaacaggatttcctttgcctggcgccaatgtgatggaaaagggaacatctaatggaacaattacagatttagatggtaatttctcattgaatgtttcgaagaagggagttactttgactgtatcattcatgggatatacccctaaagatgtggtagtgaaagataaaacaatgaatattacgcttgaagagaactctaagttattggacgaagtagtggtagtgggttacggtacgatgaaaaagcgtgatgtaacaggagctattacttccatctcaagcgaggccattgagcaaaaaatggctactaatgtttttgaagcactgcaaggtactactgccggtgtacaggtggtgtccggttccggacagcccggtgaatcttcttctatcaaaattcgtggtacttccacgttctctgccgaaggtgtgactcctctttatattgtagatggtgttcctttggaaagtatcgatggtatcaataccaatgatattacttctatggagattttgaaggatgccgcttctgcagctatctacggttcccgttcggcgaacggtgtgattattatcactaccaaaagtgggcaggaaggtaaagcccgtattgatatcaagtataatcactcgtggggtacattgtctcacaaggttccacaagcaaaccgtaaagaacgtttgttgtacgaccagtatcgtaaagagtattttgaaacatacggcggaggtaatccggatgaaagtagtgatatactgaatgatccgttgaactctttctttaatgtggataacgattatctggacatgattacaagcactgcacaaaaagatcaggtggatatcagtgtaggtggtggtacaaagaaactgaaatatttcatcaataccggttattataatgagaaaggtattatttccaatacaggtttccagagattaaatactcgtatcaactccgattattcaccgacagactggatgaatatgggtagccgtatttctttgacttattctaaaaagaaaggtctgaatgaaggtactttattgagcgcagtgttgactcgtcgtccttatttcaatacttattatccggatggctctttggtcggagtgtttaacggtcagaagaaccctattgcgcaggtcaattataccaccgactttactgattcttataaggctaacttcttccagttctttgaaatcaaattcaacaagtatttgaagtttagagctaatattaatgccaacttctatctggataaacgcaaaaaactcgaaccgagtcttatcaccgatgaatggcagaaacagaataaaggttattcttataattacctgaactggaactggatgaatgaagacatccttacttatgcacgcaaaataaaagatcataattttacggccatggtaggtgttagtgcacagcagtggcgttatgaaaacgaaacatttgtggggataaactcgtctacagattttatctatacaatgaatgcttttgccgcaaacctagatttgtcatctacaggctccacattaagcaatcactctatggcttccatttttgcccgtgtgacttatgattataaaggaagatatttgctcaatgccattatgcgtcgtgacggttcttctcgttttgccaaagagaacaaatggggtaatttcccttccgtatctgtgggatggcgcttctcggatgagaaattcatgaaattttcgaaaaagtttctcgaagatggtaagatccgtgcaagtttcggtatcacgggtaacgaagcaatcggcaattacgactatatctactcttattctccgaattctatttatgacggagtgggtggcgttattccgactcgtatcggtaaagacaatctgaaatgggaggaaactaaacaattcaaccttggtctggacttgaatttctggaatagccgtttgacagtcactgccgattattacgataaatatacagacggtttgctggcaaactaccaattgcctaaagaatctggttttgcatatatgaaaaccaatgtcggtgaaatgagtaaccgaggctttgaaatagctgttaccggtgatattatccgcacgaaggactggaagtggaatgcttctttcaatatctccagaaacatcaaccgtattgagaagctgtctgaaggtaaggcatatatggaaggtgatatctggtggatgcaggaaggtggccgtgtgggtgacttctacggatttaaaagcgccggtgtctttgcatacgacgaatcgaatgctttcactgataaatgggaacaactgactccggtgtttgagaatggtgtatttcagtacaaatatttgttggatggaaaagaatatacaggtaatattcgtcagaagacgttgccgaacggcaaaccgttccgtggtggagattacaactgggaagaaccggaaggagcccgtgatggtgtgattgatgataatgaccgtatggtgatcggtaatgccatgcctgatgtaactggtggtttgaatacaacggtgacttggaagaatttgagtttatacttaggattctattattcattgggaggacagatttataatgcagccgaacataatcgtaatatgttcaaatacaccggaactactccttcaccggaagtcatccataatatgtggttgcatccgggtgaccaggcaatctatccgcgtccgtataatgatgattacaacaatgcccgtatgggtaactcgttctatctggaagatgcttcatttattcgtttacagaacatacgtgtagcatacgatcttcctgaaaactggataaagaagctgatgttgaagaatataaatatctacgcttttgtaaacaacgctttgacatggaccaactattcgggattcgatcctgaattctctaccaacaatcctctgcaggtaggtaaagactcttaccgttatccgagaaagagagaatatggtattggtttttctgcaaacttttaattgaagatatcgtatgaagaatataaaatattttgttggagctgtatgcctggctctatcattgaatagctgttcagactttctgaatgaggaaccggtaagtgaaattccggcaggtgacatgtggcagactgcccgtgacgctaaggcaggtataaatgaaatctatggattgttacgttccactttacgggagaactatttctattggggtgagttccgttcggataatgtagctcccggagcaccggtaatggccgatcaggcacgtgttatcaacaacctgatgtctacggatgagaaatgtgcaaagtggacgactctgtatcagatgattaaccaagcaaatctggctattaaatatattcctaatatcagtatgcctgatgtggcagaccgaaatgactatctcggacaagcttatgcattgcgtgctttggcctacttctatgctatccgtgtttggggagacgtacctttgtttatagaacctactgaaaagtattcggaggccatctacaaagagcgtacggataaaaactacattttggaacatgtcattcttccggacctgaagaaagcggaaggactgataaaccgtaacaagaattacgaacgtaaacgcatttctatctgtggcgtatgggccatcatggcggatgcttatatgtggactaaagaatataatctggctgaccagaccatcgataagatggcaactattgcttccaaaaaaggcggtcgttttgtagacttcgaacctagcattgctacttggcatactatgtttacggaagagctgactaataaaccttccgatgatacaccggaaaatgatgagtataactccagagagtttatttttcttgttcatttcaatatggatgaagtcggcacgaatggttacagttatatgtatcaatggttttccggttcagggaatcgtgcggcagtcatatctgataagtttatgagtatctttgatgaaaaggatatgaaaggtgatttacgtaaagattatacagtgaagaattaccaaaatggaaatgaattgcgtaaatatatggcaggtgacatcagtaactctttgaataagacatgcgaagtagcctatccaatctatcgttacacagatatgatgttgttgcaagctgaagctcgtgctcatcagggaaaatggggggaagctttggatttagtaaaaactgtacgtgaccgtgccggattgaatacactgactgaaaatgattttgcttcagaagaagaggtcgtcaattatatcttgcgtgaacgtcaggtggagttagccggtgaaggacgccgttggtttgatttgttgcgtaccggaaagtggaaggaagtgatgaaacctattaacggtatggagcaggacggcaatgaacttttcccgatccattattcacatattttggaaaatccgaagattgtgcagaatacgtattatggtaatactaacaactaaaaaggtagaagcaatgaaaaagacaatattatataagactcttttcttttgttggacaattttggcattgaccggttgtgacctggacttgcaaaagaactatgattatgagccttcggtggatgatccgtatgtaaaagtgacagcatgggaatattttcaggatcacaaagatatgttctcggagttgatagcagctatcgagtatacaggtttgaaggactattatacccagactgataataaatatacttttctggctttgaataatgccggtatgcagctttatcgggagaatgaatttgcaggcgtagcttccattacagattgtgataaagaaaaggtgaagaatatgttgctttatcatattgtagatggagaatatagttcttatgggcaattgcaggtagaaccgatgttcgtcttgactatgctgaaaggtgagactggattgatgacaatgtctgtatggaaaaatccatggcaggctgcagtaggtaagattctggtaaatcagaccggaagcaacggaaaatctccgcaacggcaagctaagactagcaatattctgccgacaaacggtgtgattcatatatttgagaactattgcaaatattccaaataaccacagttaattaaaaagagaactaattatgattcgtaaaatatataccttattaatattaggactttgcttgggctttgctgcctgtggcgacgataatgatggactggatcctaatgcagcagctcctgtgattaattttcctatggagcagctggacgttgatttgaataaagtagacaatctgccggtagtggctgttattaaatcacaggcagggcttcagagcgtgacaatgaaattgcagacggtagagggagtgacagaatataaaactgtaaccgacttttttaaccccaactcttacagcttgtctgaaaacttggagtacaatgcaaattatgaagcttttatcattgaagctacggataaactgaatcatgttacgagtgggactttaccaattgctgttaccgatgtaatggcacgtcctgtcattacattcgatccggaagagattgtatatgatgagatggatgaaaatccggtaatgcctcgtaccacttttaaaattgtttcggaagctggtttgaagaaagtagaaagattcttagtctctgccgacggacaaacaccgaaaggcggagatgtgctgaatggcgacaaaacgtatgagcacgatgaactgatagaatataaagaaggcgataagggttttaaagtgaaagcggaagatatctatggtaatatcacaatttctactttgcaggtgtcatataagacagttccggttcctgtattgaccttgggtaaagagctaattactactgatgaaggagtagatacggaagttccgatgcacatcgaatccgttcgcggtgtaaaacaggtagctatcttccgggtggagaatggagtaagtacagaaattttccatgagcagatagtgggcgataacaagaattttgattatacccctaaggtgcaattgacagaagaaacatctcaactcaaggtggttgtttctgatggtcgggaaggcaaggaagttatagggatcgtaaagacctatgtgaatatggaagttgtccaacttaaggttggcagtcatgtattggccaatgccgaaccgttcgctctgatttcgttgaatgatatgaaaacgtattcggtagatgaagctatttccagtgtggaaagcgctaagaatgttgatataaagttctttataaattctgctaatagtgttctttctttccgtttctattcgatggagaatgtagatagcaagaatagtctgtataaaggatcgggcggaaagtccttgagcaatctgccggctaagaatatgacaaaatttgtgttattcccggcaggctttgattacgatacggtttctcgttcctctattaagaatgaatatttggccggaagtgccgatcagaaagtgtatatgacaattgataactttgtcggtagtgtgattggatttaagactagtggtaattcaagtgctggtggagaaagatatggtgtcatgaaagttcttgatgtctccggtaagatggataataatacgaccaaacagatagcaactgttgaaatcaaattccctaagaagaagtaagcagggtagtattacctaccgcctgaagtcttaatagaaaacttcttttctattaagactaaacttccctttcattgggagtaaagtttctctctgtccgatacaaactataaacgaagcttacgtttttataaatgcaagttgcgtttataaaaacaaaacttgcaattataaaaacaaagcttgcgtttatagtttataataaggataaaagaagtttgcaacaagggggaaggaagttctctcctagtggaggataacttttctattaatagccgacgcgagagttattaacagctatcccggtgaacagtagatagagtatacgaaagatgcgattgataacaaatacgatggttaagtaataatgtgcagtagctgaaagtaatatgagaaaacatataatatatagatatttcctctttttatctttggtcggactgatgcagttgacgcttagctgttcctcctcttccaacgaaatagaacctttgaaaccggaaggagaagatactcctttggaaaaagatgaatatacttttatgaatgtagaataccggaagtggcagaacggaactttccaggcatggacaacggcagattcaagggaaacacgtaccattgataatatgaattggtatactccctcttcggattatagccggactgcatggggaggacgaatcggtttacaaccttcatctgtggttggaaaagaaggctttttccgagtggctaattgtggaggccgttcttatttgctcgatccggataatggagctgttatcattcatggaattcagcatgttcgtccgggagaatctactgctcataagaaggctttcggtactcgatacggtagtgaggcgcgatggagtgaagagactggcaaactgttagcagacaatcatataaactatatttcgtatggctcgaaccgtattgaagtatttcctgctgcagtacgtggtaacttgttgacccctaagacgcaaaagattgcttatgcagagaatctgtatctgcttcgtacctttatgtgggatatgagtaagaatttgggctacgcgtttgatgatgacaaatataatcgcttagttcttctttttgaacccacatttgctacgtacatagatcgtctcgtacaagagaagtcagctttatttgccggtgaccggcattttataggtttctatcttgacaatgaattgccatttgccagttatcagggaactggatatgctaatactgaaggaggtggctggttggtgcatacacaaaaaaatagaggtgagttttatcagaacttctgtcttcgtttgcttgaaactcgaaactgtgtaggctgggtacattttgagtataatgatggttacgattctaacggaaaagcttctaataaaggagtggtttccatcgaatacgaaccttatgaatcttttctgtcgcagatgcggcagttgaatctttcagttcattcattgatcgattattacgatataaaatcggttcaatagattgacggaaactttaaatagacaaattgaatatttagaattaaaatagttatgaccatgaagaagtttagtttatttgcaatccttttaggatttaatatagctttgggagcatgttccgatgatgatgccgctcctgtagtaaaaaatgaaatctttcaacttccggaaaaggcttatgtactggcggaacaatccagacgggctattgtcatcagagatgcggagacgcaccgcaatatttggagttgggatccttatactgcctgtgttcctgctgcacagcagggttggtttgtcaatccgagtgaagtaaaaccggttttcaatagacgctatatcttgatgactgcctccggcggagctgtggctttaatccgtttgtccgatcataaattaatgttctacgcaaattgcggacagaatccccactctgcggaggtattgcccgatggaaatatcgtgacggcagaatctaaatccggtgaaatcaatacctttgtggttgacacggttaaggtattgggagcaaaagctaatacggtgaagttgggtaatgcgcataatgttgtttgggataagaaaagatcgtatctttatgctacagctaccaaaaaagagggagtgactgcattattccgttttaagtacgatggcaaccggagtaatcccaagttaataaatcagactaccctttatacattcagcaatgaatcgggtgggcatgatttgttcccggtatatggtgaagaagataaattatggcttactgctgcttcggctgtctataagtttgatttgactggagttaccgacgctacgactaatgactctaccgaacctacttgcgagaaagtttacagcatagccgatataaaaagcatctgcaacggaccggacggaatcctgatgctgaaaccgactgaagagtggtgggcagaaggacttgtaaatgagaagggagaagaacttttcaaaatggacgaagccaagatttataaaggccgttggatgatagacaatcttttcagttatccggaaaagcatgatttcgtgttgagtgaggactgattaagtatggtggaagattgattaagtacataagttgaataattaagtttggaacaatgaggaaacttcttctttttttattggtatctatcgcattaccggccttggcgcagaatggaaagaaagtgtatgccgactttcacggagtgcgctatacccggcagcatgacggaaagctggggcgttgggagatgtatgccaatacggaaaaatcaagtaccggaaggaagtcgctgtgttataatgccgatctgatagacagcgaaggacggcatgagatagcggcagtggcttatccccaagtcggaatgcagtccaatctcgatcccgattatatcgaatatcagatattgtcggcaaaagcggctaagatagatggattctttatcgaatggggattcaagcctcacgaaaatgacatcttgctgcgtgagatgcagaaagtggcagcaaagtatgactttgaaatcggcgtaaactggtgcgacggttggttgtattatgactggattactaaactttatccggaaatcaatacccgtgaggcaaagaccgaatacatggccaaatgttaccaatatctggtggatagcgtctttaccggtcctacagctcctatggtgaagggaatgcctgttttttatcatttcggtcccggagcgaaagtggatgaatataagaaagtattatcattggcgaaattaccgcaaggaatgaagcaaccggttgctttacgccgttgggcagattggggaaaactggaaaatgataaatatatccccgtcactcgtagcgatgaaatggatacctggaaagaagtgggagaaataccgactgcatggcttcctgcccgtgtccgtacaagagatcaggcacatgccgaatgggataattacgccactcaggatgatgttatcgagtttatgaaacctttccgtgattcaatttggcatagtaacaatcctgcttataccattaagtcgggatttgccatgccgggaatggataaccggggatgtgcgggctggggacgtggacacttctattatatcccacgtaacaatggagaaacttatcaaagtatgtggaagttctgtatggcagagaaggacagcctggacatgatgtttatcgcttcgtggagtgactataccgaaggacacgaaatagagccgaccattgaaaacggtgaccgtgaactacgtacgactttaaagtatgcggcggaattcaaagacgaacaggcggacgagcgtggattaaccttacctttaatgcttttccggctgcgaaaagaagcccgtttcctggaaaagacgaagatggacgtatccgcttgtcaacgttcgctcgataaggcagcattgttgattagccagggacgttatccggtggcaataggcttgttgtcacaaatagaaaatgatgtcaagacggcaaaatccgctttggcggttgagatgatgcgtttgcgtgagtcggacatgaagattcagggaaagcgaaaatccggtggttacagtgccgaagaaaccctctctatttctttgccaaaagagctggtttccaaactacaaatgaataactatgtaggctatctttattttgagtatttggacaaaggaaatgaatccctttttatacgttcgtctacgctgcgtgaaccgaaagaaccgtttaaaattgtgtcccggatacgtaccgacaacacgggtgaatggaaaagcgcaaaagtagaattgtataaggataatatcgtgaatggattcaatatgcctactttctatttaaaaggaaatgtcgtagtccgtaatttgtcattgggctatacgatctacacagtcaaataaatgcatggatgaagagtttaaataattggttattagttttatctgtactatcctgcttcggatgttcctctccggtccatgaagatgacaggggatgtgctttcgtatctgacagtattcaatatcgggtcgagtttatgtcggcggggtgcgtgcggattctgtcttttcccgaaggtgatacgctggtaacaaaaagattggtggttgattcggaaaagccggctttcaaagattataaatgggaagatacgggacagaagctgctctttcgcacccgtgaactttccgtagtttttgataaggcagatgcggctttcatttttcaggaaacatccacaggtaagttattactaaaagagaaaggggatagaaaggcacggaacttcaaacgttcggttgccggaggtgaacaatgtctcgaagtcactcaatgctttgttcctaccgaggatgaggccatttacggactgggacagtatcagaatggaatcatgaactaccgggggaaatccgtacttctgttacaggccaatatggatattgtcaatccgttccttatttcgaccaacggatatggtgtcttatgggataattattcttctacgaagtttgaagatacgaaggagggctactcatttacttccgaagtaggtgatgcctccgactattattttgtctatggcaagaatatggacgaagtcgttgccggttatcgggaattgacgggggacgtgccgatgtttggaaaatgggtgtatggcttctggcagtccaaagaacgatataagtcgttcgatgaattgaaggcagtcgttaaagaataccgtaaacggggaattccgttggataacattgtgcaggactgggaatattggggagacaaacctcattggaacagcctgaccttccatccggcaaactttaatcatccccgtcaagttattgatgaactgcatcaacaggaccatgttcattttatgctttccgtatggcccggattcggaccggaaacggctgtctatcagtctttggattctatcggtgcattgtttagtgaacctacatgggcaggttataaggtttttgatgcctacaatcctgccgcgagggatattttctggcaatacctcaagaaaggactctatgatatgggtgtggatgcttggtggatggatgcaacggaaccatctttccgggatggattcacacagttgaagcaggaagaaaagaccaaatcagctggtaatacttatctgggtagcttccaccgttatctgaacacttattctttagaaatgctaaaggacttctatcaacgcctgcgcgccgagagcgatcagaagcgtatatttatcctaactcgttccgcctttgcctcgcaacagcattatggtacagccgtatggtcgggtgacgtttcggcttcatgggagaatatgcacaaacaactggttgccggcttaaatttgtctatgtccggtattccgtattggacttccgatacgggaggattctttgtcacagaacgggatgcaaaatatcccgacggactgaaaagtaatgattataaagagttatattcccgttggttccagtttagcgcatttactcctatcttccgtgctcacggtacgaatgtgccgcgtgaaatttggcaattcggtgaagaggggacattatcttatgataatcaagtgaagtatatccatctgcgctaccgtctgttgccatacatttactcaatgtcccatcaggtaaccgccaataattataccatgttgagaggtttggcaatggatttcacaacagatacccggacatttgatattgataatgcctatatgttcggtacttccttattggtgcgtccggtatttcatccgcaatcggaagaaaagaacatctgtatttatctgccggaacacagcggtaaatattggtatgacttctggaccggagaagcttttgaaggaggaagagaacaaatgcagacaaatatcctcgacatacttccgctctatgtgaaggctggttctatcttgcctttggcagaagtgaaacaatatgcgatggaatatcccgatcgtgaactggaattgcgtatctatggaggagcggatgctgcttttttatggtatgaggatgaaggtgattcctaccgctatgaagagggcgtatgttcgaaagtgccgatgcaatggaaagattcggaacggacattgactattggactgcgtgagggaacttatcccggtatgccggaacaaataaaaatgcatgtgaaattatatctgcctgaaggtgcagctcttgatagcaaagagtgcgtctacacaggtagagaagtgaaaataaagttttaattataagtatatatcgattatgaagaagtttctctatatttttattctattgtttattgtgggatgggcacaggcgcaacagcgtgtggtatacacaatcaacgacggatggaaatttacaaaaggatctccgtttgaagcgcagctggccggctgtgacgactcttcttgggagacggtcaatatacctcatacatggaataataaagatgcagacgacgaaactccgggattttatcggggaccggcttggtaccggaaacaattgtttgtagataaaagccaggagggacgtcaggcagtgatctattttgaaggagccaatcaggaagtacgattctatctgaacggtcagttcgtgggagaacacaaaggagggtatacccgtttctgttttgacatcacttcccatttgcgttatggacaggaaaacctgtttaccatttatgtgaacaatgtctataatccgaatattcctcccttatctgccgattttactttctttggcggtatctaccgggatgtctatctgcagtttatgaatccggtgcacattgcaacgaatgattatgcttcgtcaggagtttatatccgtacacccgaagtgaacaactccgcagcctcggtagaaattactacattactgacgaataatacactccaacctgcagaaatcagggtggaaaatgtaatctgcgatgcggatggtaaggaagtgaaaaagactcatgcggaaataaagctggcatccggtgaaacaaagacagacatctctaaaaagataaaaatagattcgccccgtttgtgggatatagacgatccttatcggtatatggtatatacgcgtattctcgataagaaaaagggtactttgctggatgaagtggtgaatccgttaggcttgcgctggtttaaatttgattcggaaaagggctttttcctgaatggcaaaggacgtaaactaatcggaactgcccggcatcaggattattttcagaaaggaaatgccttgcgcgacgagttgcatgtacaggatgtactactgttgaaagagatgggagggaacttcctgcgtgtgtcacattatccccaagatcctgtaatcatggaaatgtgtgataaactgggtattgtgacttcggttgaaatccccgttgtcaatgctgttacggaaactgaagagtttttgcagaactccgttgagatggctaaagaaatggtacgtcaggatttcaaccgtccttctgttatgatttgggggtatatgaatgagatttttctgcgtcgcccttataccgaaggcaagcaattggaagattactaccgctttactgaaaaagtagcccgtgccttggaagcgaccatccgcgaggaagatccttcaagatataccatgatggcttatcataatatgcctcaatattacgaagacgcccatctgaccgaaatcccgatgattcagggatggaacctgtatcagggctggtatgaaccggatattaatgagtttcaacgtttgcttgatcgtgctcataaggtatacaaaggaaaagtactgatggttacggaatatggaccgggagtagatccgggacttcattcctaccagccggaacgtttcgacttctcacaggaatatggtttggtgtatcataaacattatctccgtgaaatgatgaaacgtccgtttatagccggttccagtctgtggaatctgaatgatttttattccgaatcccgtgtagatgctgttcctcatgtaaacaataaaggcgttgtcgggttaaacagggagaagaaagatgtttattggttctataagacagccttgtcacgtcgtccgatacttgtcattggtaatcgggagtggaaaagccgtgggggagtggtgaatacggcgcagaaagaatgtattcaatccgtccctgtattctctaatgcggaagaagtagagctgtttgtgaataacaagagtctgggaaagaaaaaggtggaagataattatgctttgttcgatgtaccgttcgttggtggggagaatctcctggaagcggttgctgtggctggtgatagcaaattgcgggatatgctccggattcagttccagttggtaggctcacagttgaaagacgaagcaattccatttacggaaataaatgtaatgttgggttctccgagatattttgaagaccgtacagcaaatgtagcatggattcccgagcaggagtataagcccggtagctggggatttgtaggcggaacttcttatcgtcgtaaaacaggattcggcagtatgcttggttcggatattgacattctgggaacggatatgaatccaatcttccagactcaacgtgttggaataaaatcttttaaagctgatgtaccgaatggagaatattccgtatatttgtactgggcagaattggagtcggacaaagagcgggaagcgttggtttataatctgggagctgactcggaacagacgtttgccggaaaccgtagcttcggaatttcaatgaatggaacgactgttttggatgatttcaacatagctcgtgattacggatatgcccgtgctgttatcaagaaatttgtagtaacggtgaaggatggaaaaggattgagtgttgactttcataaaaaagaaggagaacctattctgaacgctatccgtatttatagaaactattaatcataaacactgtcaatatgcttaggtctatttatttactgtcttttctcctcctgcaatctttatttgcttttgccgggaatgtaaaggagaatgttccgtcttcttttgacttgtatgtatgcatcggacaatccaacatggcggggcgtgcaacattaactccggaagtcatggataccctccaaaatgtgtatctattgaatgataaggggaattttgaaccggcagtaaatcctctcaatcgttattctacagttcggaaagatttgtcaatgcagcgtttgggaccggcttacggctttgctaaagagatggcccgacaaacgaaacgtcctgtcggactggtagtaaatgcgcgtggaggctcatccatcaactcctggctaaaagggagtaaagacggatattatgaagaagctctttcccgggttcggattgcaatgaagcagggaggtgttttgaaagcaatcctttggcatcagggagaagccgattgttcgaatccggaagcgtataaacagaaactgatttctttggtgaaagacttgcgggaagatctgggcatgccgaatctaccggttgttgtaggacagatttctcaatggaactggacgaaaagagaagcaggtacagtcccctttaatcagatgattaaaaaagtttcttcatttattccctattccgattgggtatcatcgaaaggattgggatggtataaagatgagaaagaccctcattttaatacggaagcacaactgttattaggaaaacgttatgcgaaaaagatactgaagttttataaacatcaataggataccctttttcgaaggaacataaaagccggctgattcatgagggatcagccggcttttgtatggtgaataactaaatactgccttgttgatagaaaaggaatctatatagttaattgctttattataagcaaattaacctgttgataactttgttgatatccttgttgataactgaaattaggttgtgaataaagtcagtaaagaagagtcgtcataaaaaagaagaaccgcatttctgcgattcttcttatctttagttgcggagatccgactcgaacgaatgacctttgggttatgagcccaacgagctaccaactgctccactccgcgatgtttaacgggtgcaaaggtacggctttttttgaaacaaacaaataattagccgaatatttttcgaataaatcatcacttttttcttatttggttgagaatgaatgaaataatgatgaaactttttcttagcacctattaatatacaaatgttaatattctctctattttcttgtatggtctaaagaaaagaattacttttgctcaaaatattcagcaatgtgcaatttgtaacctatgaccgtatccaagacaaaagccaaattagtagatgtagcccgtcagctttttgcgaagatgggagtagaaaacacaactatgaatgatatcgctcttgcttctaaaaaaggtagacgaacgctctatacttattttaaaagtaaggatgaaatttatttggctgttgtggaatcggaattggatattctgtcggatatgatgaagcgggtggccgagaaaaatatctcaccggacgagaaattgttggagatgatatatacccggttggacgcggtaaaagaagtggtctatcgaaacggaacattgcgtgcttatttcttccgtgatatatggcgggtggaaaaagttcgcaagaagtttgatgcaaaggaagtccagctctttaaagctgttcttctagaaggacaggcaaaaggagttttccatattgacgatgtggagatgactgccgacttgatacattattgtgtgaaaggaattgaagttccttacattcgtggccatataggtgcacatctggatgaagatacgagaaatagatatgtgtccaacattgtgtttggcgcactgcatagaacagaaatttaattaaataacttttagtatgggattattagacggaaaaacagccattgtgaccggtgctgctcgcggtattggtaaggctatcgctcttaagtttgctgccgaaggtgcaaacatcgcatttactgaccttgtcattgacgaaaatgcagaaaatacagcaaaggaacttgaagcaatgggcgtgaaagccaaaggttatgcttctaacgctgctaactttgaagatactgcaaaggtcgttgaagaaatccacaaggacttcggacggatcgatatattggtaaacaatgccggtatcactcgtgacggtttgatgatgcgcatgagcgaacagcaatgggatatggtaatcaacgtgaacctgaagtctgcatttaacttcatccatgcttgtacacctatcatgatgcgtcaaaaagctggtagcattatcaatatggcctctgttgtaggtgttcacggaaatgcaggacaggctaactatgctgcttccaaagcaggtatgattgcattggctaagtctatcgcacaagagttgggctctcgcggcatccgtgccaacgctatcgctccgggattcatcctgacagacatgacagctgctctttctgacgaagtaagagctgaatgggcaaagaaaattcctttgcgtcgtggtggtactcctgaagatgtggcaaacatcgctaccttcctggcttctgatatgtcttcttatgtgtcaggtcaggtgattcaggtagatggtggtatgaatatgtaatcgaacagaatgactgttgtatacgaagacaaccatatcattgtagtcaacaagaccgcttccgagattgtccaggcagacaagacgggggatacgccgctttcggagactgtgaaacagtatctgaaagagaagtatcagaaacccggaaatgttttcctcggtgtgacacaccggctggaccgccccgtaagcggtcttgttatttttgccaaaacgagtaaggcattaacaaggctcaacgaaatgtttcgcaccagtgaggtgaaaaagacttattgggcggttgtgaaaaatgctccgcaagaaccggaaggtgaactggtacattttcttgtacgtaatgaaaagcagaacaaaagttatgcatacgacaaagaagtgccgaacagcaagaaagcgatcttgcattaccggttgatcggtcattcggagaattactatttgctcgaagtcgatttaaaaaccggacgtcatcatcagattcgttgtcagctggcaaaaatgggatgccctatcaagggagatttgaaatatggctctccacgctccaatccggatgggagcatttgtctgcatgcccggagagtacggttcatacatcctgtctcaaaagaactgatagagcttgaagctcctcttcccgaagggaatttatggaaaggattcgccatagattaacacggatttccacagattcatttattatgttatttagtagacggtacgcagtttttctgtggaaaaccgtgtaaatctgtggttggaacttgccaaaagagtaaacctgcctgccatttttcttgtaaactctagcgacagttagttaattcctaaataggtagtatatttgcatcattcgctaactataattttcaatcataccaaagaaaaatacgaatgaaggcatttaaactacttgcacttacttcttgtgtcttgcttgcagcgggaaatggagtagcgcaacagaactattcaaaaagtgaaggattattgcagtacgtcgatccgtatatcggatccggttatcatggacacgtctttgttgggacgagtgttccgtatggaatggtacagctgggtcctactaatatccataaaggttgggactggtgctcgggttatcattattccgatagtattttaattggcttttcacatacccatttgagcggtacgggctgtactgacttatgtgatattctcatcatgccattgaatgagatccgtactcccagaggcaatcaggatgatatacgtgatgggtatgcttccagatattctcatgcgaatgaaatcgcccgtcccgaatattactctttgcttctcgaccgttacaatatcaaagccgagttgacagctacagatcgtgtaggcttccatcgttatacttatcctgaaggaaaaccggcttccatattaatcgacttacgtgaaggaaacggatcgaatgcttacgacagctatatccgtaaggtagatgattatacagtagagggttatcgttatgtgagaggctggagtccttcccgcaaagtttattttgtgttgaaaagtgataagaagatagagcagtttactgcctatgatgataataacccgcaaccttgggaccaactgaaagtggcatcggtgaagagtgtcctcacttttggtaacgtgaaggaagtgaagataaaagtcgccctttcttctgtcagctgtgacaacgcagcgatgaacctgcaatccgaacttactcactgggattttgataaggtggtggatatgagtgccgaccgatggaataagcaactggagaagatgacagtagagactgatgatgaggcttccaaacgtgtattctataccgcccattatcatactatgattgcccctacgcttttttgcgatgtgaatggagagtatagagggatgaatgacatgatttacacagacccgaagaaagccaactatacgactctttctttatgggatacctaccgtgcattaaatcctttgatgactattactcaacctgaaatggttgaccatgtagtcaattcgatgatttccatctatcgtcagcaggacaaactccctatctggcctttgatgagtggagagaccgatcagatgccggggtatagctccgtgccggtgattgccgatgcatatctgaaaggatttaccgggttcgatgcggaagaagcattgcaagcaatgatagctacagctacttatgaaaagcagaaaggagtaccttatgtagtcaaaaaaggctatatccctgccgacaaagttcatgaagctacttccatagccatggagtatgcagtggacgactggggaattgccgctatggcacgtaagatgggaaagacagaagatgctgaaacattctcaaaacgtgctcattattacaagaactattttgattcttctatccatttcattcgtccgaaactggaagacggctcttggcgtactccttacgatccggcacgttccatccatactgttggagatttctgtgaaggaaacggatggcaatatactttctttgctccacaagacccctatgggctgattgccttgtttggaggtgacaaaccttttacaacgaagcttgatggtttctttaccaataccgacagtatgggggaagaagcatcgagcgacataaccggattgatcggacaatatgcacatggaaatgaacctagccatcatgttgcttatctttatgcgtatgccggtgaacaatggaaaacggcggaaaaggttcgttttatcatgagcgatttttacacagaccagccggacggtatcatcggtaatgaggattgtggccaaatgtctgcctggtatcttctttcatctatgggactctatcaggtgaacccgtcggatggtgtatttgttttcggtagcccttgttttaagaaagtagaagtgaaggtacgtggtggtaacacttttactgtagaagcacccaataacagcaaagaaaatatctatatccagaaagtgtatttgaatggcaagccttatgataagagttatatcacttatcaggatataataaatggcagcacattgaagtttgtaatggggaaaaagcctaataagaattttggtaaggctccggcaaacagaccggttgttttgaataagataaatggataaagatggcttacttataaaagacagctaattgttgaaaggaggaagaagcctccgacaatgaaagaataaagctggttctcaatattcaattcagttttcaataggtattataaggctttccgattgtagcatttaattctgcttcggaaagctttattttatactagaaacggctgaaaagcaaatccttaacaagaacttactgttttcagccgttttggggaatatagttttaagaaataagttagtcctgattacatctttccttaaaaaaagaatgtaatcaagactatttttataactatggaagcggatcagcttttgccggtcgtttcggatcataaacggctactcctactttggagtcagcacaaccataatacaaataccatttgtttttgaagtagaccattccttctataaatacggttccatccacatattgcccactcttttcaaagctatccatcggacggaagaacggttcatcgagacgggtgataaagcgggtaggatcattggcgtcgaagagtgcttgtccggcagcatagacattggcggtatagcgtttgtcacctcttcctgaatggttcttaccattataaagaaggacaattcctttcggagtgtagatagctggaggcccacattcggtgagatggctgtcgaagtagccgtcacggggagaaaacagcttctttagggaaccgtcaatgttgacaatcggtgtccagtggattaagtcatcggaagtagctgcgaatacatgctcctctccccagtacataaagtatttcccgttgactttcttgataacctgtttccctttaacaacttcggtcaggatagagccggacttacaacccaagttgaagaactttccatcaaatgctttggcaaaagcaggaccgtgttttgtccagtcttttaggttgcgggaggtcgctactgccaggcgaggtacatggcgattccattgggtgtacatcattacatataatccgtcatcggttacggcaattcgtgggtcttcgcagccgccgggccattccaactctttttgtgaatcattatccggatagaatacaggagtcttttcccgttggaaatgtgtgccgtcggtagaagtggcataaccgaggcgagaagtcctgtgtccgataccgacacctgatttatcctctgcacggtataacacgacaatctcaccattgtagagtgtagcagccggattgaatgtatcgttcgattcccacgcaatagaatctttggtcaatggacagtaaaacttggtgttttctataggagatattaccggattgacattctttggacgttcaaaaccaccgaaagcccaatcgggtaatttgttctctttatgattggaagactgtccgtaggcagtacaggtcatcatggttgtagtaagtaggaataaaaaagttgatttcatattgttcatattatatgggtcatttattttttaggagtcatatactccctacatataaattggaaaataaataaaatgctgtcatctgtcacctgattgggcataaatgattgattataaatatactgcagtgtgacagcatgatgtgacggcaaggtgacgacaactttgctgtcactttgttgaaagcaaggattttattgtttctctgctatgtgggtacttatttctctatccggagcggtattcaaggattatcagactattacagaagagagagtttcagtacttgaaactaaaagttctattgcttgaaacttctgtttcgtcagtgggaaactttagtttcatcggtgagaaactctagtttcacttacttgaaactatggtttcaaaggcctgaaactaaagttcttcaaccttgaaactactttggaagcgtaggcttcaaggttagaaacagttatctcataagcgggaatacaataaaaacataatagaagactattggatactattcagcaagtctacctttccttcattcacgagttttaggattagttctccgaacagcgtattttgccatgcaaaccaggaacgagtaaagtttttcgggtcgttcttgtggaaagattcatgcatgaaccctgttccggcatccgtatccatcagcattttgatacaggtcttgatttctgcgtcgttttgactggtgaatgctttcatcataatactcatgggccaaatcatatcatatccgatgtgcggaccgccaattccttcaccggcagtacctttgaagaagtaaggattatcttcgctccatacaaacttacgggtattctgataaataggatcgttcactttcacatctccaagataaggcagggcaatgagactcggcacattggcatcatccattaacagttggttgccgaaaccatccacttcgaaagcatagattttgccatatttcggatgattgtaaaccgcatattttttcagggctgcttccacttcgttcgacagtgtagtacattctttagctaaatcaggtttcttgttgactgtattcagaatttcggcagctttgcgcaatgaagttacagcaaagaagttggatggaacgaggaactggaaagttgtagcatcatccgaaggacggaaagcagaagcaatcagtccgaccggctttacaggattaccccagccgtcgttggtcatcgtatcgagtgcacgttccgttttacgttggaaacgataaggacctttcggatcttcttttcgttgctgttccttaaacgttttcagaaccttggcgatggctgtaagccattcgtcggagaatatactggcatctcccgtcgtcttccagtaatgataagcgagacggataggataacagagcgagtcgatttcccatttgcgttcgtgcagttcgggcttcatgtccgtaaggtcgctcatccattcgccgccttcggaattcatgttgaaagcattggcatacgggtcgatattgatacacttgaactgacgtttgataacgccggcgagcatttttttcagttctgcgtctttgttggcgagttgcacgtaaggccatacttgtgcacccgaatcgcgcaaccacatggcgtggatgtcacctgtataaacaaacgtatcgtctttaccgtcaaaatgaacagtagtatccagtgtgttcgggaaacagttttcgaacatccatgctaagcgggcattcgtcagcagttgcttgatatgcgcaatctgttgttccacagcttgtgagacaaacagacgtttcgatgtttccggacggttcgtctgatagttgttgattttggtattatcttgttggatgacaaaatcactgttcgttatagcctgcatattgctagcgcccaagagtgctatggacaaacaaaaggctttagttatattcatggtaatagtctttttttgttgattagtattgattatgaaagtgttgcggagaagaagtgttaaatctctgcaaagaattcaataagacaggcattgtcgagcagccatttatactgttccttgttgtgtcccgaccaatccctgcctaataatccgttttcatcccggtagttttcccaggcgtgaagcgcattttccaccatcgcattgacatacgccggattcttgtcaatcttatacagagctttcagtcctctgaataagatcacgttaaaccaggccatgtctttatgcactttgacagtcgggtctttcttgtcggcttttgtgcggaaaaaggcatctgttcctgcggctgtttgctgtgcatcgtgcaaatactgctcatctcccgtttcctcatagagcaatacacccgcctgaatcatctgtccactgttgtaggcgtacttctctttggaaactttccctttcaggttgatgttatcccagtaaagatggtcggtagggtcgcacagatgctttttcgtccaggcatacgtctcttttgctttttcgaggtatttggcatccttcgtcagccggtacaacttgacaccgagcacagtagacggtgcattggaacaagtatgcttcgcttccttctgctgttcacaccaaaagatgccaccgcctatctcatcgctccatccactgtagatatattgatacaatgcaacggctttttccaaagatgcaggcttgtgagtcagttggtaataatcgcagtaatccagtgcaatccagatgttatcgtcataataacgtccgtgctgcccgtacttggtggggtatgactgataacaggccggcaagcgactgttatcccaatactgctccattcccggtagaattcttttctcgagaatctttttgtacttcttgtttccggtcgctttgtataaagccacacaacccgacatcatcccggaatacggccatagaaaagaagccttcagcgttccgttctgctgcgttccgtccgccagataagtgattttttggttgggattgacaggatacgtttctgttagtagtccgtcattcgtctgatagagattcaatacattagatagaatcgagtcggcaatagaaagataacgggtatttcccggtgtctttcccactgcggaggtaaggcaaaataacatacaggctacaaaacatatatttctcataggaatatcgggttgtgtggtgaaactttcaggttataactagatacaaagattatttctgctgacgctggtcgaactccagttccacctttacggggaaatggtctgaaggagtgcgcgcctgataagtcttgatgtcgatttcttccgggcaatcgttcgcctgcttcttttctcccttgcctacgatgctgcggtaagtatcagtcagcacaccatatcttttcacttggaaagacggagaaacgaatatatggtcgatacggctttccgtaaagctgttcgggtcgaagtcgttgaacgtgccgttgatagcatagcggaagccggccttctcgtaagagtcgcacaacacccctttgctcacaaaagcatcataagactggtgggtctggtcgacattgaagtctcccgtcaggatggccggaagctctttgcctttgccaagttctttcatcttgtcctgtacgaggaatgcactttccacacgtgccttcttgccgatatggtccatgtgcaggttgaagaaaaggaattcgaagccggtatctttgcatttgaagtgtccccaactgcaaatacgcggcaacacggcatcccatcctttgctcggcacgtcgggagtttccgacaaccaaaaatcacctttctctatcacgtcaaacttgtctgtgcgatagaaaatagcagaatgttcacctttctctttgccgtcgtcgcgacctacaccgatataatcataaccgggtaatgcctcttttatatctttcagttgatgaataaagcactcctgcgtgccgaaaatatcgaaatcgtggtattgcactatttgggcaatgaccgggtaacgttgtccccaaccgtttccgttgattgaatcgccaccgttggcgtttctcaaattgtaggaggcaacggtgatagaagtaggctgatagttactttgacaaccgcaaaagacgatcgcaacaagggcaattagtaaaaggtttttcagtttcatgtttttatagtttgtttggtagataattcattgatctccaaaagtacaatattttattcaaacgaaagagagtaaggtacatctttttctgtggttccccgttgtttattgggtacggggctcatttgaaattgaatattagcacctttaatcagctggtcatgtgtaaggaaattacgggtttgtgatttcccgtttactttcatttccttgatgtagcggttgtcaagctggttgttatctgccttgattgtgatggtctttccgttctccagatgtaacttcgctgatttgaagagcggggttcctatgatatattcatccgttcccgggcaaaccggatagaaaccgagtgcggagaatacataccaggcggaagtctgtccgttgtcttcgtcaccgcaataaccgtcgggaccggcggtatatagtttgttcataatctcacgtatccagtattgggctttccagggctcgctcgaatagttgtagagatataccatgtgctgaataggctggttgccgtgcgcatattgccccatgttcattacttgcatttcacgcatttcgtgaatcatgccgcggctttccattcccagtttacccgggatgacaaagacggaatccatcatcgcgttgaattctttcttgcctcccatcaggttgataagtccttgcgggtcgtggaatacgcagaagctccagtgccagctattcccttcgcaaaattcaccgctccagtccactgcatcgaaattcggattgaatacgcctttgttgtctttgccaaccatcagtttgcgttccggatgatagacatttttgtagttcagcgcgtgtttcttataaatgtcgatttcgctctccggtttaccgagtttcttgcctaatgtataaattgcccagtcgttatatgcatactccagtgtacgtgcaacgttttgtcctatgccgatattgttggcaacatatcccagttggttgtaagattcgtaaccgagacgacctgaagcagtcccgcgaagatgtgcatttgctccatgtttcaatgcttcccaaagagtttcgatatcatatcctcgcaatcctttgatgtaagcgtcggccactacggaagccgagttgttgcctaccatacaatcccgatgtcccgggctggcccattccggcaggaaaccgctttccttgtaagtatttactagtccctcctgcatcttttgattcattgacggatacatcaggttgaggaaagggaacaagcagcggaacgtgtcccagaatccggtgtcggtaaacatataaccgggacgcacttcgccgttgtaggggctgtaatgcatgacttgtcccttagcatctatctcgtagaaactgcgtggaaaaagcatggaacggtataaacaggaatagaaggtgcgtaatttatcgatattatcgtcttctatctctattttactcatttcacggttccaaatctctcttccgttcgctaccagttggtcgaaactgtttttgccaagctctttgagattcaactccgcctgttcggggctgataaaggaggaagcaacacgtgcgtgtacgatttctccctttttcgtggcgaatccgatcacggcccctgtgtggtttccttttgcttctgtttcattcggaagaatgttgttttcgaaaactgtggaaacgaatgtgaacggtttgtcgaattgaatcacgaaatagtttttgaagttttccggcacaccgccgctattcttggttgaatagccgataatcttgttttcttccggaatcactttcacataagaacctttgtcgaaagcgtctacaatcacgtaggcattctttgtctccggatacgtgaaacggaacatgacggcacgctccgtaggagcaagctcggttgttacatcatggtcggcaaggtataccttataataataaggtttggcaacttccgctttgtgagagaaccaactggcacgtcggtcttgatcgaataccagtccgcctgtgataggcatgatggcaaactgcccgtagtcgttcatccagggactgggctgatgtgtttgtttgaatccccggattttgtcggcatcatacgtgtacgcccaaccgtctcccattttaccggtctgcggtgtccagaaattcattccccacggcaatgccgtagccggatacgtgtttccggtagacagttcaaacttggattgagtgcccaccagtgtgctgacatagtctaccggattcttaacggcagaagattgcaggctgtacaacacggcacctccaagaaatagcaagtgtttaaatgaaaaatgtgttttcatgaacaaatgaatttattgatttgaaaataatttctacgacgaaaatagggagaaaaggaatgtgcttctagtaatagaggggctaaatcgcctcttgtcgctgaagttaactactctggcacggaactttacttatattccggccaaaaaaaagctcggaatgtttttttgtttacctttgtcatatagcaaatctaagaataatacactatgggaaaacagtcggtttttattctattcttttttcttaatctgttgatacataacgcttatgcttataatttgaagcaagttgcagataaagagtatatgtctaatagttcgattacatctctgtgccaggatgagcgtggattgatgtggattgggacctgcgacgggctgaatatttatgatggacaggagattgaggaatttaagactcgtgacaaggaggattacttatctggtaatctgattgacaatattgtgtatacgggcgaagatatttactggattcaaacctactatgggctgaaccgtttgaaccggaaaaccaatacaatcactcactataatgaatttcagaaactcttctttatgaataaggatagtcatggtaatctgttcattatccaggatagtaactgcatttattattatcataaaaaagaaggagtcttcaagaaaatcaatatcacgggaatcccgatttccgatatcgtaaacttctttatcgacggtaacaaccggatgtgggtagtcatgaaaggatataaccgctgttatgatatacagcaggaagccgcatcgggagatatcaccctgttaccccagaaaacgaacctgatttatcagacttccttgatttattgtttcaatgacgagcaatctctttattacatagacaaggaatttaatttctatgctttccatattccgacccagaagaatgagtttattgccaatctaggtaaagaaatacaggaacgtggcaaaatttcttccatcgttcattatcataacagctattttgtgggctttttgatggatggtattctgctgttggagaaacagaaggagacgaatcattatcaaattcagtcgttacctatcaacagcggtgtattctgtctcaagaaagaccgttttcaggatgttgtttggattggtaccgacgggcagggtgtttatctttattcgaacccgctttattctatcaaatcaatggtgcttagcaattataccgagaaaatagaacgccccgtgcgtgccatctatcttgatgatgaacgtactttctgggtgggaaccaaaggaaacggaattcttaaaatctatgattacgaattcgataaaaacatctccgactgtcgggcggaggtgttgactacctctaatagtgctttgagtagtaatgccgtttattgttttgccaagagccaccggaatttgctttggataggagacgaagaaggattaacttattattcatatcgggaaaaacgtatcaagagtataccaatacggatcggtaacgaagatttcaaatacatccatgacatttacgaaacagcagattccgaactgtggctggcgagtgtcggcatgggagtggtgaaagctcgtattgccggaacaccggacaatccggtgattgtggatgcgcaacgttacatcatcaatgacggcgaactgggatcgaactatttctttactatttatgcggagaatgaagccaacctgttgtttggcaataaaggatatggggtattccgctataacgaaacgacgaatggcctggaaccggtgtctactcacaaatacgaaaacatgaccctgaataatattctcgctatcagtaaagacagcagcaataactatcttttcggaacgagctacggattgataaagtacacatcggaaacctcttatcagctcttcaatgccaagaatggtttcctgaataataccattcatgcaattcttagaaactcgtccgacgacttctggttgagcaccaatcttggattaatcaatttcgatacgaaaaggaatgtctttcgttcatacggttttggagatggtttaaaggtggtagagtttagtgacggagccgcttttcgggattcccagactggtactctgttctttggcggaatcaatggagtcgtagctatccgggcggatggccgtccggagcagctttatatgcctcctgtttattttgataagctgtctatcttcggtgaacaatacaatctgggcgaatttctcacccggaaaaaagaaactgaagtcttgaatttgcagtatgaccagaatttcttttctgtttcatttgcctctgtggattatctgaatggtaataactgtacctatttctataaactgaaaggattgagtgaccaatgggtaaacaatggttcggaaagcggagtctcttttacgaatatggctcccggcgaatataccttactggtgaaatattacaatagtgtttttgataaagagagtgatgtctattctctggtgattcgtataggtgatccgtggtatgcttcctggtgggcttatttgatttatgccctgtgtctgcttttactggcagccttgctgatacgttcctttatcctgcgctccaaacgtaaaaagcaggaattgctgaacgagatagagaaacgccatcaaaagaatgtctttgagtccaaacttcgtttctttactaatatcgcacatgaattttgtactccgctgactttgatttatggtccttgcggacgaatcctttcatcgaagggacttagtaaatttgtcgtggactacgtacagatgattcagacgaatgcggagcgtctcaacaacctgattcatgagttgatcgaattccgtcggattgaaacgggaaacagggaagtgcgggttgagtcattgaatgtgtcttccattgtgaaaggaatagccaaaacgtttgttgaaatggctaaatccagaaacatcactttcttgagcaagatacccgagcaggtgatgtggaactcggacaaaggattcctgaatacaattattattaatctgatttctaatgcctttaaatatactcccgacggacagagtatcaagattgaagtggatacgagccgggaaaatatgctggctcttcgtgtagcaaatgaaggaagtaccatcaaggaaaaggattttcagtatatttttaatcggtatgccattttggataatttcgagaatcaggatgaaaagaacttttcacggaacggactggggctagccatctcttataatatggcaaagttgctgaatggtacgttgaaagtggaaaatactcctgacggatgggtgatgtttacactaaccttgccggtcgtgaaactgactaccggagtgtcggaaaccaagcggctcacagcggaatacatccctaagatagatactcaatcgatactgaaacttccccagtatgagtttgataagatgcgtcctacgcttttggttgtcgatgatgaaatcgaaatgctatggtttattggagaaatcttctcggctgacttcaatgtggtaaccttgcaagatcctgaacggctggatcaggtgatgaatgaggtttatccgaatgtgattatctgtgatgtcatgatgccgggaatgggtggcattgaactgaccaggcggattaaatcggtgaaagagacggcgcatattcctattattgtggtttccggacggcacgagatggaacaacagatggaagccctttctgccggtgcggaaatgtatatcacaaaaccgtttagtgcggagtatcttcgtatctctgtctgtcaggtgatagaacggaaagaggtgttgaaaaattatttcagttcgccgatcagttcttttgaaaagtcggacgggaagttgacgcataaagagtcgaagaagttccttcagtcggttttgaagattatcaatgataatataacgaacaaagatttgactccgcgttatatcgccgatcgactggcaatcagtccccggagtctttatcggaagatggaagagataggagaggatagcccgaccgatctgattaaggaatgtcgtttgcacatagcgaaagatttattgctgaccactaaaaagacgattgatgaaattgtattcgattcgggattctcgaacaaagttactttctttaaggtgttccgtgaaaagtatgagtgcacgccaaaagagtttcggatgaaacatttggaagaggttcagcagtagcctgtggcgggaatttttaaagaaaaagaagaagtaaatatccgtgttaatatagtaaatatccgtgccaaaaggtaaaaaaggatagttaattttcttttggtagagtttagtgattttatctttgtctcatcgaagtttttaagtagataaacttgaaaagtattaatttattaatctttaatctaatgaaaaggaaacttagttttttatttctttcagcattgaccattccattttttatggtatcgtgcagtgatgataaagaagaacaggaagtgaaaccggcaacagatctggttgtcgataataattcggtgacactactacaaggagacgaaattacggtgagtatcacctccggtaatggcgattattatgtgaagccatttgatgaaaacgtggcgacggctacaatcaatggtaataaggtgactattaaagctaccgaaaatagccagttggaagaaaataaccgtacggaaactactatattaatagtagatggacgtaagaaagtggctagagtgctggttcgggtagcaaaactctgggatttgacggtagatgcaccggaagaaggttttgacctttttatcggtgaaaagagactggtgaagattttgaccggtaacggagattatcagatttccataccggaaggtgctgataagtttttggaagtgggtgaactatccggacaagttattccgttgactgccaagttcgagactggagccgatccggtaaatattacgataacagataagaaaggtaagacaatcactattcctgtggtagtgaacatcgtggatctgacactgaaaagtaatgaagccacttttgccgaaccggatgccgaatctcaatatatctctattgagagaggtaatggcggatatagtttcacttatcaggtgggagacagcgagcctactacgaatgcaacgattgtggaagctactgaaaaagagaacctgattaccttgaaacccaaagctagaggtgatgtgaaagtgattgtgacagaccagaaaggttctgtggaggagatttcggtgaaagtgaatccatataaccttaaactggaaaatgaagcaacttctttaatcatcggtggttatgaggcatctacagaaatagctattaccagaggaaatggtgattataagttggcacaactcacagatgataataaaacctatttgaaaaccgcagaattgattacggaagacggggctaccaagttaaaactaacaggaaagaagctcggggctaccacactggaactgtctgatgcggcaggtcagaaattgacgttaccagtttatgtgaatccggtatgttatcgtatggaatatgacgtatgctttaaaattgatattaaaaagtatgccgaatcacattcagaggtgaaaagtatgaatcagcttacttttgaggttgtgttctacccgacttatactcgttctatgcaatcgtttataggtttggaaagtgtattcctgcttcgtgcagaagctaaggatgtgaatccgcgttttgaaatagccactaaaattaatggtaagagtgatccccgtttccgtagtcagcaaactatttattgcgatgattcggaaggtggacgtaagactccgggtaaatggtatcatatagccattgtatatgatggaacgaaatcaagtactaaagaggcttataaaatgtatataaacggggtgagagaaacgttgactcctgcagataactcttatgaggattgtgcccctaattcatctctcaatctgacagatgtaggtggaaatgataaagcactgttgattggacgttccggagattcatatcgggtaggatattgcaaagtttatcaggcacggatgtggaagagagcgttggacgaaagtgaaattaaagcgaatatgtgcaaaatccttaatgcagaagaacactctgacttgatgggatattgggtattctcgaaaggtgtcggaggtactacagtttttgaaaattggggaaatggcggcagcggattggatgcgcaagtttgtttgcagaatataagcgaaaataaacctgcctggggagcggaacttcctgcaacttataatggagataagagccgctttgaaccaattgaatgtcctcattcatactaaaactaggaatataataatatgagaaacaatatgataacaaaaaaactaatcaaatttgccctgctgttttttcttatcggactgacggcttgtgacaataaactgaatccgggatttgatccggatgattatgaaccgattgttccgcctgaacctgttagaacaatggatgcaatggctagtggcgagcgagtagtactttcgggtgcttcgttgacggatattgttctgaaatggacgcctaccgagaaacacggaaatacagtatatcgttatgaagtattgattgatacgatcgggggagactttaccaaaccggtagaaacgatcttttctgacaataacggtttggaatcgcagttgactttaacccattatcaggcaaacacaataggtaaactggctaaattccgttgcaataccaacggcacactgcgttggaaggtgcgtgcttattgcggattggatcaggctcttagtagtctggaaggttatttcgtaatttttatgatggacggcattgatgatatgccttctgaaaacgagccggtttatatcactggcgtgggcacggaagatgatggtgatgaagcggaagcacaacaaatgctccgtcagaatgaaggaatctatcagactttcactcaattgaaagccgaccagccatttatatttatgtctactgtagaaggtcgcaaatgctattattatgtagacgacaacggagtgttgcgtgagcgtaatgatggtgaagactatacagttacggttcctcaatcaggcatctaccggattaccatcaatatgggtgaacaaacgatcagttacgatgaaataggagctgtatatctttataaccattcgggtgggtatagacaggatttcaactatctgggatatggcaaatggggtgtgaagaattatactgcccggaaacaaacggaaagttgggcaggaagcggtgaaacccgtcatagctttaagatggaaatcaacggaacaacctaccgttggggacataaggagaaagataaagggcaaccgaatctgactaccgacaacagctattataatttatatcaactggcattgggcacagatccatgggattacagtttccgtttctgcgacgaattactgcaatggggcgaaaagcagggaaatgtctattatgctacggtgaaaaccgatgtaaccctctatttcaatgctgagtttggaacgtacacccaccgttgggtagcttcggaaacgaatgaagattaaaactgaataataatatgaagaactatatagtatcattatcaaaaagagctttgttgttaagtggtgcactggcaatatttacagcttgtgacgacggcgatctgggagacatctacaaaggtaattcatccggtgaatatgtgtcggatgtgaactggacagatgcagccgacaaaagtacgggaacttatatcaaatatttctatgagaatgccagcggacgggataccttttgcggaagcatttactgggaaaaaccgaatacaccggaaaccggagaaccggcaagcacgggcggtagcggcggatggtcgcagggacatgcattggacatcgtgatcgatgcttatatccgtcacgcaaacaatcccgaatatcaagctcatttgtatgaaaacatcatgaaacctttcctgccggcttttgatgactggaatgaacattgcggttatggtggcaaagacttctggaataacttctatgatgatatggaatggatggcactgtcttgtctgcgggtttatgaattgactggcgatcaggattactacagtgcgttgatgaagatgtggaaccatatcaagggagcgaagaatgactataaaggggtaggaggaatggcatggaaaacggatgcgccggcttcacgtatgtcttgttccaatggtcccggttgccttctggctatgaaattgtatcaacttaccgttaaggaggctaaagacggctgggaagagcaggctgcttattacctgaacttcgccaaagaggtatacaactggatgacggcttatctgtgtgatatttccaccggacaggtatatgataatcttagtattaaagatgacggaacaccgggagatcctgataaagtagccttgtcttataatcagggaacatttatggcggctgccctggagctgtacaacgctacaggtgaggatgaatatcttcgtaatgcggttgctttcggctcttaccaggtgaataagaaaatggattccaactatccggtattcagtggtgaaggaaattcgggagataatcttttattccgtggaatatttgtccgttacttcctggatatggtgaaacagccgactaacagcctttatccggaaaagaccaagaataagtttatcgctgcattgcgcagctgttctgatgtgctttggacgttggctcatcccgaaggctattatgtgtgggagtacgactgggcaaaagcaccgaccttcggtaatcgtgacaacagggaagatcgcctgacaatctccttgaatgcggaagtcccgggagcaacaatgattgaaatccgtgctcgttatgaagactgggtacaaggtaaagcaacggaaaaggccaactgggtcggaccggatttcggtaagaaagcagaggaataagattgatttattacacatagaaaatcgaaaagaaagatgatacatataaaaagaaatatttgtctggtggctgtttcttgcactcttcttgcaggtatacctttgcagggtgtggcgcaaacgggaagaacggcaaaggtgcaggccacacaaagtaataaaataacagtgtcgggtacggtattggacaagacgacaaatgacccgttgatcggtgtgtctgttgtcgtgaaaggggtggccaatgcaggtacgattaccgatatggatggtaagtttacattgaagctgccttatgcggaagctccgttggtgttttcttacctgggttaccagccacaggaaattgttcccggtgcaaagaaggaactgactgtcttactacaggaagatacgaaagccttgcaggaagtggttgtggtaggttataccaaacaacgtaaagaaacgatgatcggttctgttgctaccatcacgacaaaagatctgacgcaaagtcctactgccaatatcaacaatgcgcttgccggacgtctgccggggttgattgtaaaccagtatgcgggtggtgaaccgggtgtggatcaaagtgaattgtttatccgtggtaaggcaacttacggtaaccagagtgccattgtcattgtcgatggaatcgaacgtgacatgagttacctcgcaccggatgaaattgaaacattcactatcctgaaagatgcttcggccactgccgcttatggtatccgtggtgcaaatggtgtaatcgttattactaccaaacgtggtaaggcagcggaaaaggcaaccgtgaacctgaaagcctctatcggtattaaccagccgatcggtttccccgaatatttaggctctgccgattatgcaactttatataatgaagccagattgaacgatgccaagatgacgggcgcagacatcagcagtttgaaccttttctctcaacaggcgattgacaatttccgccgtgcgaaaggagacaattccgatggtttgggatatgactgggattattatgattttgccttcaaacccggtttgcaggaagatgtcagcctctccattcgtggaggtacggacaaggtacgttattatgtattggccaattacttttcacaaggcggtaactacaaatattcgaatgccggtgaatatgactcgcaaaccaagttcacccgttacaacttccgttcgaacatcgatatcaacattaatcgttatttgagtacccgtttggatttgggggcccgtattaccgaccgtaatgcaccgggtacaacagccggtcgcctgatgaccatctgtgctacccagcctccatatctgcccatcctggtggaagaaaatgcgcatccgcagaatgaggaatacattcagcaaaatcctcgtggaatgctttatggtgacaatatctaccgttacaatcttctgggtgaattgagccgtaccggttatctgaatgaaaagaacacgtatctgaatggtagttttgccatgaatctggatatggaatttctgacgaaaggattaaaagcggaagtgatgttctcttatgatgcttctgaaggacgctggattaatcgtaaactggatacttacaaagacggttatcgtgaatatccgaaatatgcgacgtttatgccgatcgaaggttcggatgcttatatggcaggcggacactatacgggtgcttacaaaacgggtaacaaatatgatattgaccagactattggcaacggattcagtcataacgcttctgacggacgtacttatatacaggcacgtttggattacaaccgtttgtttagcaaccgccacgaagtgaccgccatgttattggcaaaccgtggtaaccgtactgttaacaatgaactggcttatcatagccagggtatcaccggacgctttgcttattattataatcagaagtatctgatggaatttaacttcggttacaatggttccgaaaacttcgctccgggcaaacgttacgggttcttcccagctggttcaatcggttgggtagtctctgaagaggaatttatgaaaaaggcttcctggattgacttcctgaaagtaagagcctcctatggtttggtaggtagtgacaacgttagcagccgtttcccatatctggctttctacggtggtggcagcggttatgatttcggtaataactttggtacgaatgtaggcggtacttccgaaggtaatctggctaatgcgaatctgacttgggagaaagcccgtaaactgaatgtcggtatcgactttactaccctgaaccaacgtttggcattgacgatagatgcattttatgaatatcgttttgacattattacagatatgaatagtgacggtatcatgggatatccggatattgtaggtaaagatgcagctttacagaatctgggtgaagtaagcaaccgcggtgtggatatcgaattgagctggaatgataagattggaaaggatttccgttactatattcgtccgaacctgactttctcccgcaaccgtttggaatataaagcggaagttgcccgcaagaactcctggcgtaaagaaaccggtaaacgcttatacgaaaacttcgtctatgtgttcgatcattttgtagccgatcaggaagaggctgaccgtttgaacaagatcggttatcagccgtggggacaattaattccgggagatgttgtttataaggatttggatcgtaacggagtgattgatgatgaagaccgtacagcaatgggaaatccgcgtagtccggaactgatgttcggtattcctttcggtttccagtataagaactttgattttagtgtattattgcaaggtgcgacaaaatcatctattctgttgaatggggctgctgtatttgacttcccgcaatttgaacaagataagatcggacgtgtgaagaaaatgcatctggaccgttggacaccggaaacggctgctactgccaaatatccggcattgcattatggaacacatgataacaacaagaatggaaacagtagtttgtttttgtatgatgcttcctacctgcgtcttaagaatgtggaaattggttacaatgtatcacccaaattattacgtaaattccatgtgcaacaggcacgtatctatgtgcaaggtctgaatctgttgacttttgataaactgggtgatgtggatatagatccggaaacgaaatccggagacggagcttcctggtatcctattcaaaaggtattcaattttggtattgatataacattctaaataagatagaaatatgaaaaagttatatagattttcagcaattgctttattggtcctgccgttggtctttacttcatgtagcgattacctggatcgggacgatgatgataatattacggaagcggacgtttttgcccgttacgaaaaagtgaacggactggtttccgacgtatacgcggctgcaaagaaagcagaccgtccgctggtgttctttgagcacttcagcaacagtgccattacggacgaatgtgaaggaaccaacgtagagggaaacattacgaataacttcaataacggtgcctggaacccgaattctttgcccggtagtgtagggcaatattgggaagctctttatgaaggaatccgtaaagcgaacctgattatagaaaatgtacagaagtataacacgcccgacaacccacagcaggatggtgatcttcgcaaccgtatcggtgagatgtatttcatgcgtggttatttccacatgctgttattgcgtatgtatggcgaagctccttatattgaccgtgtgattaatgccggagataatatggacttcaagaaagaatctgttcattcgatggttgaaaagattgtgacggatgcgcaaactgcttatggcatggttcctaataaatatgtgaaaacttccgagaattttgggcgtgtggataagggagcctgtctgggattgatttcttttgttcgctgggtagcggctactccgttgtggaacggtgcttctcaatatggatacaacttgcgtcgtgtgtttgaaaatgagtatgcttatgatgctactcgttggagaaaagccaaagaagcggctaaagccgttctggatttcgaagtcggcggaaccaagcgttattctctctatacgaaacatgatgcaaatgatttcaaggatccggctgacggtaatctgaatgacagccgtgtatatgctcgtttgtgggatatgttttatgatatggatgcctttgccaatgagtatgtgttctttatgacgaagagcaaggatcaggcatggcagggtgatatttatccgcccagccgtgagggaagttcgcgccagcaaccggtgcaggaacaagtggatgaatacgaatatatcgtaggtgattatggctatccggtatattcggcagaagcccgcaaaggtggctatgatgatactaatccgtatgtgaaaggtactcgtgacccgcgtttctatcgcgatgtaatttatcacggagctccttaccgtaataataagaacgagtcgaaaacgatcaatacggcgagtggttccgataagattggtgctaccaatgcaactactaccggttattatttacgtaaattccaacaggagtcatggaacaaatccggtaacttcagtatcaatgcgcccgccatctggcgtcttccggagtttatttatatttatgcagaggcttgtaatgaattgggcgaggatatcgatgaagcttataaattggtgaatacggttcgtgaacgttcttttatgaaaccgatgccgccggaagtaaagactaatcaacagttgatgcgtgaatacattcagcgcgaacgtcgcgtggaacttttttatgagggaaaacgtccgtggacttgccgcttgtatttggaacccaccagtaaggaagagctagcaaaggaaagcctttggaaatcgagcgggagtgacaattcaaaacgtacacagaaatactgggctgccaataacggtgcattgccccgttgccagcgaatgattaacggaatgcgtccggtgcaggatgagaatggggccattacggttgacggtgtgaaatatagaatggagcgtttctgcgtggaagaacgtacgttctctattcagcattatctgttcccgattcgccagagtgagttgcagaagacaccgaccattgaacaaaatcccggatggtaaaccggtaggaatgtataactttaaaaagaaaatcagatgaaacgaatctatacatatatgtgtctgttgcttttgtcggtattatcgtttgccgttacaggttgtgatgacgatgacgatgtggctaaagacttgatagagttgattgtgaacaaaccggtaatacgtatcgggcagaatgaggaagccaaagtgaatgtagtggttggaaacggaaactataccgtgagaagtttcaacactgccattgcaacggctaccgtttccggcgaattgataactgtaaaaagtggctcacagaatggggccactaccgtcgaagtaatggatggagaaggagtagttgccaatatttctgtgaatgtaggtgtatttgaattggaagtgaatgaaccggaggtgatcttggaagttgccggtgaaaagcaactgattgttagcatgggaaacttttccagcaatgatgaattgtcttatgaggtggaggatgaaacggttgtcagcatggttaatacagatcagttccgtcctttctatactttgacaggtttgaagaacggacatacaacagtgacttttacagaccataaaggaaaacaggcagtggttcaggtgacggtaaatccgatttctatcgatgtctccaacctgacaccgagagtgggagtcaacaataagatcatgattacggtagaaaaagggaacggaggttatagtctgacagcagaggatgaagagattgtagctattcagcaggtggatgacactcgtttcaatttaataggtaaaaaagcgggtatcactaccgtgtttgtcagagacgaagcggaacaggaattaagtctgaccgttacggtggtacaggcagataaagtagcgaacctaggtagcggtaattactttaaagtaccgtttgaatataatggtacggcagatgaatcgctaaagaatttgagtacgatcacatttgaggctcgtttcaatattgagtcgttgaatggcaatgacaatggaaatgcccggattaatacggtgatgggtatagagaagaaattcctgctgcgtgtcgacgtgcataagggaggaagcaatgatgaagaacgtttccttcagcttgctgcagatgataaaggtagtattcgctatgagggctctactaagatagaaaccaataagtggtatgatgtggctgtggtattggataatagtaagagcggaagcgaacggattgcattgtatgtaaatggtgtcagagaaacgcttcaattatcaaacggtacgccggatgatttgaaagagatcaatcttacttctgatttctacatcggccagtctgatggtaaacgccggttgaacggagctatcagttatgcccgtatttggacaaaagccttgtcggatcaacagatctccgagcagagcggcaagttgttgagtgaggataaggatggaatggtagctaattggttattcaataatggaaatggtaataccaagacatttgtgtccttggcaggaaagagcttcgaagcagaggcggcaaatattgtttcaagttggaaaacagatccgatattggaaacaagtactcctacagaataattgtaagaagataggataataaaaaagccatccccggaatagacgaaagtagggatggctttttttgtagtgtgcttactattcttcggcagactatgtcctgcatgttgttggcaaggttattccttgacaggctcagccggtttgtcttttgatgtagtgtctgtgacaactgtatcattgacattggcggcgagtgcaaccagtgatgcctttgcaggcgcgtcttctttagttacagtatcttttactactgtatcattgacaactgttgcattgatttctgtcggggctgtcacagcttctgcagaactctgagcctttacaaggaatgaaccaccacaaacaaacataaacattgctactactaatactaattttttcataatcgtttgctttaatgattattagacatatgttttcaattctctacctttgtgttaaggaatcggttattgcttttcgctaacgtctaattaaagatcaaagcgcgtgccaaaattagataatgtatgataagtgattgataaataagggaatgaggaagatgatgccaattaggatagtggggaagtatgtgtggagtgtgtggaaactgtggcggggagtgtggaattattccacactccccgccacagttcttttatttaggtaatctatttacttaatttcatccggccagggacaaggtttacctgtcgctttgaaagtcggtcgttgtgcatctacttttcttagaaagttgcccagctctttagaaagtttcttcacgatgtccggatgctgtgcactaaggtcgttgctttctcctatatcatcaggtatgttgaataactctttcttgcctgttccatagtaataaatcaatttccagtcaccgtttcgaacggcacaattaaagttgattccgggaccgtcatttccccagttgttaggcatattccagaaaaggctccggcctttagaaggattgcccgtctgtttcaacagagggacgaaactgataccgtctatcggctgaactgttttgtattttttgattcctgccatttcgaggatcgtagggtagaaatcttctatcagtagatacttgtcacatttgctgtccggagccactacgcccggccaactgacaatcaaaggttcgcggatacctccttcgtaagtagaacctttgccgctatttaaaggataattctgtgtatgcagtttgccgtcacgccatcccgattcggatgcaagtcctccgttatcgctcataaagatgatgatagtgttattggcttctccgttcttttccagccagttcattaagtcaccaagacttttgtccattccttcgataagggtggcataagctgcttcgtggtcggtcattcctttcttcttgtatttatcatagaaacgtttatccttgttaagcggtatgtggatagcatattgagccatatacagatagaaaggttggttgtatttctttgctttatccagtgctttaatggcttccaaagtcagcgcttcggttacaaaagtctccgtaccccagtatttttcgagtccggggacagccatcagtgaaatcggtttcccgtctttggtatgtccgtagttctcttcgccgagatagctggcgagtccgccggcagcgtgtccggcaatatttacttcgaatccccagtgatgcggatcttctcccggagtatctatggcaccgaaatgggcttttccgcaatggatggtgtgataaccgctatcttttaggatttgtacgaaagaagttcctacaaaggtattgttagtgccgggtacttggctgataccattataattccattccggtacagtaagcagcttatctttgcggtctgtcatagtgctttttttgagtgtccagttggttacccggtgacgcgctgcgttagctccggtgaggaggctgcatctggaaggagaactgatactgcttgcatacgcttgggtaaacatcataccttgccgggcaagacgttccatattaggcgtctcgtacaattcgttatagtgtgtcttttgcgtccagaatgggagagaggtgtcttgccatcccatatcatctaccataaagagaatgatgttgggacgtttgcccgtcagttccgtctgtactttactttgtgcttgcaaagcagttgcagcgagcggcacaagtgcgagggggaatagtttctttttattcatgggggtaattattaagtgttatttactgatttcaattttaccaggcttttttatcaggatactccgcagttcctgtttcccctgggattccacccatatccttagcgtccctgcacaaagaacatttaatgtcagtgtttcattggtacgggaaagtagctgtacggtagcaggtgataaatatttttcctgtattccgattattccccaaccttgtcggataggacaaaggtggaataaacagtctgtaaagccttttaatttcatttctttatctgtagccagtatttcagctgtttgttttttccagttgaataccaatatactatcagcaggaaaataaccggttgtccttttcgggacaaggtagtctttagggctcacgaatgttttcacttctttatggatgggagaagtattgaggttatagcaaataatagaaacggcctcgtctcctgtaggtgctgatacccggtagtctttaccactttgcaaaggattagtcagaatagattccagagttgggattgccggtgcggaagggcggaatatttttcctgattcatcaatgagaggtagtatgttgtccggaataaagtcacttggagaatcggataaataaacgggtccgccggaaatagccttggaacgtgccatcaagctaccacaaatcgtatcagaggaatgaaacatgtcatgatccggccaaacagtctgtcccagcagaagtgtattggtgtatgactggaacagatgtgattttgccatgttttcatcatactttttgtagtcaatgctgacacgggtaacggcgctatgtaatgtattgtctgtgtttattatattctgtgccatacaattcattaagcctatctgtgctttgtcggtttgacgttccaacgcacggttacagtctttagcctgtcggataacctgtgtattacccatataaagtggaagagtgaaagattgattatctattttcagaaaatcaaatccgttctttttcatcgtattgacaaaatattcgtaaaaggtatcgatgttagtggcgcttgtaccgggcagcaggctgccgttgtaggaatacaatacctgccggactttgggaggaaagtcattactggcagaaattcccgcccaatagcctgaaagggcgtaccataatcctatccatttgattttatctgtttgtttccgcttcatgatgcgggtccaaccattgggaaaacgttgcttgttcggagtcaggctggtcaactggcggtcttcattggctatgtgtccgtcatcaatcaagacataacgtacggggatgccggatgcttcaatagcattcatgtcatttaatattttagtctcgtcaatatcataatgataatgttcccaagtgcaccatcccagataatcgaatgcctcgaagtattctttatctactcttctttttaaggaagatacctttttatctgcaatcaacgcattataggcgttgccaaatacatcatatacagattgtgacctttgagttagaaggagaggtacttttcccgttaaatggtcttctccaagtgtagagatataaagtgtaagtgttccgtcggcattgacttgaagccaactcaggctattgtctcctgcaacggctttaacaaacaaatactcgccgttagagagttgaagaagcaaggcgtctcccagcgtggaaggttgggagttggaagggatgcccggatagttatcccgggtaagctcctgcaaccggacgaacatccaggggagcaaccggttggtattattgggccattgatgatcgtcggtgcgggagtcacggctgaagaatgctccacaaagatacggaggcagtgcaactttatacgaaagtgtattttgatgttcgggtactgattgttcgtataagatgggggcggatggaatataggtgttcaggtcgataacttttttcatccggtaagctgcaatgtcttcgtatccttttcctttatagtaagtgaacggattttgagcaagcattgctgtggttgccagaatgctagcgaaaatacatacacagatgtggattattcttcccatactcttgtattatttgacattaaatgcactgaaattgataatgtccggcagtgcgatagaaccaagaacagtaaaccttaacgcggatgcttctaccagctcaaacttttcgatacgcttgtgtcctacagattccccggtgcggatagtttgccacttcccatttatttttgcttctatcttatattggcggatacgttcaccgttttttatattttcctggatgatacagtaatttacggtttgtttctttccgaggttcagagtcagacttttcttttgccccgaagtatgtgctaccggtgaagagaaccgacgatttatttcttctcccatctctttcagtcgttgtgcgtctcctgtagggataagcccggtggggtcaggagtcaatccgaggataagggtggcatttcgtcctacggacttttcatatttatccatcaggacgtccaacggataaatgttattctcgtcatccggttcccaaaaccattcgtgacgtccgtttgctcctcttagtggtgtgtccgccatggcaggaacccaatacttaccgtctttatcaccatgttttaacaactctaattggtcggtgttactttcaatacgtttatgatgtgaacagggaactggaaaggtagaccagcagggatattccaccgtacccgtttccgagcctccccaacggaagtcggcacggtcgatattatgatagaaaagacactccggttggtatttgtttacgattggttctacatcgggaccgtcaccatgcggatcatcagctccgccgtcaaaccatatcatatataggtcaccataacgtgtgcaaagttctgtaaccatcttttcgcacaggcgtttataccaagcctgacggttccgggcaaattcaccctcaccttcagctttgaagttgtgaatgcctagcagggaattccaccggatacctacgtaaatgcccggttgaataccgtatttgcggcaggaattgacgaaatcgcggactatatctccttttccgtctctccatttcacagctttcaggcagtaggggttgacatcgctttgccagagtccgaatccggtttcatgggtggctgtcagtacggcaaacttgcatccggcagcttttgcggcttctacccattggtcggtatttagttctgtcgggttgaatatgttgtaatcttcaataggattgatgcgattgttgccttgtccgtagcggataccgtcaaagacatgcaagtcgtagtgaaacacggctcccaattcggcttcatgccatttcaattgatgtggcttagggacaggaatatcttgttgttgtgcaaaactgcaaacggaacagaagagaaagagggaaagataataaaattttctcatggtgtttatttattatggttttatataatttgcaaatgggtcatcggtttgggtgagccagtctttcagttgtttgcagaacttccggactagccggggatgttgtttggcgatattattcatttgatgcgggtcttttgtccggtcaaaaagaattgtgtcatctattacgccattggtggcatgtactacaaaagtatgagcctttgtgcgcagcccccgatatccggtggcatgattgtcaaactgcacatagtagtatggctgtacgacttcccgtttgctgcagccgagaatctcacgggacaggtcgaacgtctgcacagtttcggggatttctttccggaatcccatcaaggataggagagaaggatacaggtcggcaaagccaatcatcagattctcttctttgcgtggctttatccgttccggccatgaaataatcatagggatgcgcattgcttcttcgtagaaaatatctttacctgcattttcgtgggcacccatacaaataccgtggtcggaagtaaagactacgattgtattgtcaaaaagtccatttctttttagttcgtcaatgatacgccctacattctcatctacacccgtgatgcaggcatagtagttacggatgttgtttctaaaatagtctcccattgttgttcctttagcaggaatgtccggtcggttggcgcagagtgcttctacatccagatctttgtatatggctttgtaattgtccggcaccagttcgtatcccgtatgcggcggattcatcgaaacgaccagtgcaaaaggttgttgcttgttcttttgtaattggatatattcgattgccttgtcagcttcataggcaggtccccattggtttacataatagaaactgtcacggggagcggtcgtattccaatacattggtttcaaatgatagtcatacgttccgtaagctatccaatgttcgaatccgtgacggcgttcgggcggacaccattcgttccatgctacttttcctctattattataagtatccacataaggtttatatggagaatccagatgccatttgccgatatatccggtctgataattcatgtctttcaatacatcactccagcagcgggcgtcttgtgaaagctctactccatagggggctgtttgcgaattgcaattgcctgtcactttattgtgaatgggatacatccctgtcattaacatggctcgtgccggtgacgaaacgggatagctgctgacggcattggtaaacaagactccttcggaagcaagtttgtccaggcagggagtttttaccagttctttgcctatgcaaccgatagcgtctccgcggtattgatcggccataatgaaaactaggttgggagatgtttgtgataagactggaagaaccggagcagcgattgctgctccgattatccatgtccggtggtatatcattcttggggtagtattcatgaatacaaaaatagcttttaatttctaatggattatgttgaatacctatttattagcatagagattggagcctatcggccatcccggattctgatatactaccgaagtggttggatctcctcctttcactggggttgacatacggaaaacgtcataagaaatcggggtgagatagttagcctcttcaaagttatagccaccgttggcgatagttaatgcgtttttagcatgtggctgtaagtattttgtttcagctatatctagtcctcctcttatttgttctttgtaatatatttgttccttgtatttttcccagttaaatccttcaactgtataatccttcattttatccaacgaacgccatctaaataaatcgtccttacgcatgccttctgctataaattcgcatcgacgttcgcgtcggatattatatagcattttactgatttgtttatttcctgaccacacggctaagtcattttctttattcaaatcggtattgtctatggtgagttggtaattatcagatactcctgcgcgttttcttaatgctttccagtatttttgactgtttgcatctattgagttaccaccgtttttcatacagtctgcttccatataattgagaaaagcctccgatgctctgaatatcatgtaagctagaggtgaattgtctgttggagctacattgctatctctccatcccttccgcactacgtaacctgtggctgttttacttaaattttgatatgcttggagtaaattggcaaatatcatcactctgttctcgcttagagttgcacctcggtatactaaatcaccaggtttaaaggttgactccactaaacgcaaatctcgattcttcattacgctttcaatgttgttgtcgccttcatactggtcgtttgaagcatagattggaagtccgtttttagtaagaaatgtttctaccatagaacgggtatatcctcctccaattcctagacagccttcagtgtttatgctatgatagttgccttctattaagctatttactttggcatctgcactatacatgcgccacaataatacttccttgttagcagataaatcgtattggttgaacatgttcatgtaatcattaatgtcatctgtgattacttcgtaaaaggcctctgctactggttgggctgctttcatggcctgagacaggaagaaatttatttctgtatccagattgtcgctgaaagtgcctcctggccatcccggacctcccggaacacgtgctgttccttgatggtaggtttcccaactagcctcatataaggcaacgcgggatttgaaaagtaacgctgattcttgattcaaccgatgtttggttaatgtattgctgcgtggaagtaatcggttgatagcttcgtccaagtctcctagaatgaaacgtgcgacttcgttacggggtttacgtttgttagcttctacattagcagcatagttgtcagcgattagttcatctttgattatggggaagtcaccaaattttcttagatattcgaaatagatataagcacggaagaaaaacatttctcctatatattgctgtgtttctttattatcttcaagtgtcccgttttctacattttcaagagtataatgtaggaagtggttacagtcgcgtaaatgttcttgtcggttataacttccatcgcttgccactttgattcgctgtggaaggaatagatcttccggatcgtcacctgcttgattatcgcttttttggtcttcagtaaaaaggttgatatctttgtaatcaggtagtaattcgtattttttgttacaatatgcttgaagttgtatgggctctgtgaagaatccatcatctacattatcagtcaatggtttcctgtcgaggaaatcgctgcatgaactaattgtaaatgcagttgctataaatggtaataggatatatttaagtttcataatcagtctgttttaaggtttataatgtaatattgattccacaagataatgtataacttatcggataggtcataccattttgatagagtagttctgggtcaaaattcttactcattttacttcctgtccaaagattatccccagagaaaaatacacgcactttctgcaagttgattttttgtgtcaatgttttgggtaaagtgtatccgatttgtaggtttttcagacggatatatgctgcattctgtaaatagcggctttgcacttgttggttctgcttgctatctatgattgggcgtggataataggcatttaagttggcacctaactcatcaccttcggggcggaaaaagtcccaatgttcttcatatcctgtagaatcccattgtcctccgttgattccccaaaatatcatacctttttgggttgcggttttgtcgtctccccccacccatatgtctcgtttggctactccttggaacattagactaatgtcgaagcctttatagtcagctcccaatgtgattccgaagcgatagcgtggcgtactgttgcctataatgcaaaggtctttcggatcgcttgctgaagtccctttttcaattgctggattgtcatcaagattggcatacataatatctccggccttccaaatattattgccaatattaggtaatctgctttgatcatggatagcaatataatcttgaatttcctgatctgtttttgccatgccaacggttttaaatccccatatttctccaagttttttccctttccaataattatctacaatatttccgtcagaatctttagtaaaaaatgttttgtcaagattggggtattctgtcacttcagtttgtgcatcagataagttgagagatactctatagccgacttgccctattctatcttgccaatttacttgtaattcccaacctttggttcttagagctgtgttattgagttttggcgctgaagcacctacaataggagatatttcttctgcaggtcctaccatgtcctttgtatcacgaatatagtattctgcatagccggtcagtcggttgttgaatgctccaaagtctatgcctatattatagctggtgacacgttcccatgtaagtagggaacttacgagtcctggggaagatgcaatgctcgatttattggcttgttcgagtagccaacgtcctccttcatcgacactgcctactgtaatattttggatagaataagtgggataataattatctgcattctggtttcctagactaccataagaaaagcgaactttaaataggtttacataatcctgtattggttcccaaaactgttctcgggcaatattccatcctacagaaacagaaggaaaagttccccaacgttcatcgccacggaagcgtgaggtggcgtcccttcgaatatttgcctccaataaatattttccgtcataatcgtaattgacacgcgcaaagtatcccattgttgcccattcttttgaatacgctttcaggttacttgtacctgtagcagtgttaatactcggaactttttcgttaacaacatcgtaacgtttgccttccagattattaatataataatactcggaattcatacctgcagttgctttgaaattgtgtttattccatgaatgttcgtagtcagcgtataatgcagtggtcatcatggatgtctgttgcgtttcgctttgtacaaatgtctttccggcagccaaatcaggatctcctcccagccatgcttcttctactggctgattgtcataagtataaagatatactttgttgacgttgtattgatgccggtagctttcagtgcgtaatgtagcttgtccgtgaatgcctaaacctttgattggagttaaatggaaaccgccttgagtaaagtaggtgtctttacttgagttagaacgtccaccggaagttagctgcattaatttagggttacgagtataatgtccattgttatcatataacggcattgtgggatacaatttagtcgtttcagaaaaaaaacggtcaccataaagtttcatgaaagtaggcatactgatatcttcacggataaaacgggcattgaaatcaagatttagccacttagtcacttgtccgttgacctttccactaatattataacgcttctttttctcatcagaataattcatttgtccttcttgtgagagaaaagctcctgaaatataatattttactttttcgcttccaccagaaatacttaagttatgttcttggccaaaagatgttttgtctatgaagtttcgcggccaattttgattgtcgttagagtccatattaaatgcaaaaaagtctgttgaaccttgcctaccatttggatcagatgtgtatggatattcgccagccatatacttttggatgcggtcaatggtttcattactaaataggaatgtagcggtgcttccactgtttgcttttgctgcattgaaatatttggtgaagcgatacgaatcaagcatgtccggtatattggttggacgggaccagcggaagttatcagaatattggatagttgtctttccggcctctccggatttagtagtgattaatatcacaccgaagggagctcgggaaccgtagatagaagaagcggcagcatctttcagtacggagatattagcaatatcctgtggattaagagaattgatatctccttctgctccgtcgattaatacgagtggtgaagcactggaacctgttcccagatttcctgcgccacggatattcatgctagggctatagtccaggcgtccacctttgtcatttatatcaatattcagtccgggcataacgccttgcagggcttgcgatacggaagtgacaggtcttgattcgagagtcttggtatctacggtagctaccgctcctgttagattcactttcttttgcgtaccgaatcctactacaaccacttcatccaacgtttgtgtatcttccgttagcatgattctgaaagtagtttgattatcgtctatcgttagacgttgtggttggtatcctatatatgatactaccagtacattgcctttagacacgttttttagagagaagttaccgtccatatcggtaatagtcccattcgaagttccttctactaatacgctggctccgatgatagggtcgttgagccttttgtccgtaacggtacccttaatgctcaattgttgtgcatacatcatatgaatacccagcaataacataatgaataatactgttaattttctcattgcattttatttaaagttaaacataaagtttttataaatatctaataagtaccctgtgtcgctttataatcatatttactaccttggtataaatcataaagtttaggatcccattctattctaggtatataggtatgtgtagagattgttgtatctctttttccttcaaactcagttatcatgtttaatgtcattcttaaaaagattttagttgcgtcaaagtaaaaatcttcataagtatcagcttttggtagaagaattggactaagtggtccgtaataaaagttgtatgctgtaagactgggccgtaggctgtcaatgcgtatatagtccccatccttataatcgaaaatgtatttataacgaccatcgtacatcatactataggtacgtcccaattctccataatcaaaattagagaaaggattagtaggagttttattacttttattaccgtaatttattacgtcacaatcaacccatttttttatgatgtgattctccaatttgggatttataatcaaattataaccatatttgctgattcctctgtatctaaatctaaatgccttatcaccattataagatgataaatcaattgtaccaaatatatcaccaagtggatccatgtaaataataggcgtctctgttatattccaatttcctaattccccaactttatctttattaaatggtattctaagtcctaagataggactggttccattgaatgtgaacgtgccggttactttacttgttcccttagttgtgaattgtaaatcactggttgttgtcgtaattttgctggcagaagcagtaaaatggttaaatattttgttaactcctgctttgataagtgctccgccgacaatccctattatcccttttgaagtgggagcattttctttagaatctttatttactttgtcattaatccatttttcagcttcttttccaacaaaactagtgatattctgtgataagctagataaaggattagaactaccatgacttaaaattgctccgttagaataactttgttcctctccaaataagttcacatttgtagtatttaaaatatttgaattgattgtgaatatttgattagtattatcttcagggtcatatgctagctgcacttggaaacaattccatcccatttgaaaacccttattctctaaactaataagatttgtactagcccaataatttacttttcctaatgcagttggaacagatacttcccctgtgtgatttagccaataacgtgaaggagtgaaatcaatattccatgtacctgtattatttgagtaattgttattctccagatagtaaaaggtttttagtattccagttctaaggttgtgaaatatcatgtagtttctattattttgggcaccttctgatgctttaaaactatgaaaaatcatttcccatccatcttcttttttgatatcaaatgctatattgacaggtatattgccatctgttacactgctccaaggtaaattaactacatttccgctggctagtgtaacactgctatgattttcccaatcagcttcaaaggttgtgccatttcttgtagtggggctattgtctttgtattctttagatagaggaaatatgtttcctttggcaagttcactatcactcgttcttttttgttgaatgatattgtttaactcaatttcattactttggcaagaagccaatagtaagcagattaagtagagttttgttttcatattgattctatttgaagttatacataaggttattgtatcacaaaggtaggtcaattgggactttgcgggcatacatgcttctttcattcatcatacatgttcaattcatttgccattttcttattgctttctttgtatgttttagctttatttcgtttatttgctttaaattgattctaaaatgaggagcttaaatctaatcataatcatattgtttatcagtagttatcctttgacttctgcttatgcattctttgataaggatattcatctgctgacaatgcaggacggactggtagacaatacggttacttgtatatataaggatgaagacggatttatgtggttcggaacgaataatggtttaagtcggtacgatggcaaggcgattaagaatttcagccctttggagacatccattccggtggaggaaatagtgaaattgtccggagattatcttggaattgttgcaggaagccggctttattgtttcaatagaaaacaggaatgcttcatccctgcagttttggaacaaaagacagaaggagtgtcggcattgcgtttattgccggtggacgatacttctttttgggctatatccggagataaattgcagttgtatcaatgggaagaacatgcgcttcagtcggagtatccgggttcgcttcatataaaacttcaaaaggaatttaagttattatctgaaaagggagaatccttctccgctatttgttctgatgaagggggaggattatgtctggcaaccaattccggctatttattactctttcatcctgataatccccagtcgtatagtaaagttttgttggaagcggaaaagcctgtaagagtgacatctatattatgtaaagatgaaattgtttggatatccaccatttcccggggaatcattcgttatcacaaacagaatcgtcggatcgaccgtctttcgtatgacgcaactgcaaaagagaaccagctttcccataccgatgtttatcaggtcataccgatcgataacaaccgctatctggcggtgacctggagtggatataccttattgatgccggataaggagcatccgcagaaactgactactgagatttataataatacagcctcacaagttcagcaaaatctggaaacccgtatgatttcagcatattatgacccgaacggagttctgtggattgggacaaacggaggcggagtgatgtgttcggacttgcggtcgcagttttatagccgtttctatcaggacaggcataatgaaatttgcagtataacgatggacaatgattgctttgtatggctggctacttatcataaaggcattatgcgaagcatggaaccttatgaaacgggtaagcggctacagttttccacagtatattctgctgcgggagatgcggatgaaacagtattgtgctctttgaaagatgcgaaaggtaatttgtggtttggaaataaaaacggtgaattggttgcttatgatgtaaagtcccgccagttcagtgtttatactttaattatagatggcaacgtcagtacttcatgggtttgggcattgtatatggatgcgcatggattcctttggatcggtacggaacaggggcttttgctttttgaacctaaaaagggagtttgtaggcgtctgccggttgaacagaaattgaatagcaaggaaaagctagttgtacgggctattgttcaggcggaggacggggctatttggttgggtacgagtaataaaggagtatgtaaggttacggtttccgcatccggtgatatttctgcgaagattggttatgaatctaaaaagaatgtcgaatcccggtctgtacgttcattgttagtttcttcggatggaaacttgtatataggctatatggatggctttgctattctttctccccggcaggattcaattcgtgagttatataccacggccgatggcttgtgcagtaactttataggttgtataacggaagatggcaaggggcatatctggctcggaagcaactcggggatttcccgttatagccgtcatcagcatcttttttataattattatattgccggtagtaaccgttcagttttgtttgctaataatacgttgttcttcgggaataatcagagtatgacttactttaatccggatgacgtggatgcttatcctgtcaatgaacgggtattggtaacgggactggaggttgacaaccgtcccgtagaaatagggaaaaagataaataatcagatcatactcaacgagggtgtctcttttatcaataaaattgtattggataatgacaaccgcgacttttccctgactttcaacaacctgtcttactctaaggaacagcagaagtataactaccggcttttgccctatcaggagaactggctgatatccgatgatggagaaaaggcttcgtacactaacctgcctgagggagattatatatttgaagtaaaaaacatctatccggacggacagacaggcgcggtaactgctttgaagataaagatactccctcattggagccgtacaacgcttttccggctgtttatcctacttgtggtaattggaacggtggcttatcttgttcggttggtaagggtgcggcagcggcgtctggaacgtgaaatgcagatgaaacatgaattgctgacagtcaatctggaacgtgagaaagagcgtcagatgcgtatggaacgtgagaacttttttacgggcgttgcccacgaactgcgtactccgctgactttgattcttgctccattgcaggagttgatgaagcagtgtaatcctttggaaaccttttataagaaactccaagtgatgtataagaatgcctcttcattacataccctgatagaccatctgctgtatgtacagaaaatagaggccgggatggtaaaacttcaattgtccgaagccgatttggtagaagtgataaagagcgtgtcggaaccattccggcaaatggcggagatcagaggcttgcgttttgaagttagtttgcctgaaagaaagctcctgtattggatagatagagtcaaaatagtttcggccatacagaatcttctttctaactcatttaaatatacatctccgggaggcagtatcttgctgtctgtttctcatacccggaaagacggtcaaggttattgccagatagccgtttctgatacgggaatagggattccggtggatttgcagaaacatgtgttcgaatcattcattacaggagaaaatgtgccggagatgtcgacaaagatagggatcggattgcatatcgtgaaaaatacaatggatttgcatcacggcttggtgactttggaaagtatgccgggtgaaggaagtacatttgttttatatattcctgacgggaaagaacattttgcaaaagatgcatacgaaatggttgattgccaacaggagtatacggcgcaaaataatgaaccggaaccatttccgttgaaaccggaaaacagcacacaggaaacggctgctaaaaagagtctgctgattgtagaggataatgaagatgttcgcgaatacattcggagcttgtttatttccaagtatacggtatatgaagccggcaatggtgaggaaggtgtgcgcatggcgaaagaaaagcttcccgatttgattatttccgatgtgatgatgcccgtaaaagacggttttacttgttgcagggagattcgtacacagcaggaaacggcacatattccttttttaatgctgactgctaaagcagaggatgtggatgttctgcaaggttcgcgtagcggggcggatgattatatgatgaagccttttaatcctgaaatcctgaaagcgaaagtcgacaacctgattttgcaacgtgaacagttgaagaggatttataccaaagctttgatgctgaaacagaaatctgaagagggggaacaggaagacgcctttttgttgcaacttatccatgctatagagacgaatattcctaatgaaaacttcaatgtcaaaatgctggccgatcaactgaacatgagccagcctacactataccgtaaagtaaaacagcgtagtgacttgtctgtgatagacatgattcggagtattcgtatcagtaaagccgcttcgttgattttggaaaaccggtactcgattcaggagattacggagatggtcggttattcggatagccgtacgcttcgcaagcattttacagaacacttcggggtgtcgccttctaaatatatgggacctcctacgaggtttccatttagctcgtaacggtacggatttaaattaaatactacatagtgaaaaaatatctatcataagtatcattcattttaataatcattttattatcagaagaataactatgatagataccttttaaaaaaggtatctatcatagttttattgcaaaaaacagctatctatcatgcctatactttgtctattttagtgtagtattaggtgagattacccatttaaaggcataagaatgcacgttttataggatgacaacctgtatttgacagcttaataatctattgggagcggtaatgtttctatagcccacgtatgcaggctgtacagcccgcatacgtaggctgtatggtttacaagcgtgggctgtacagcctgcatacgtgggctataaacttatcaccgttaaagttggattatcaagccacgatcatcggatttatacaggttcattgcaataaaaacaagctatcttatgcatataggacttttattcggctattttgttgatgatagataacctgtttttgctggtaaaagcatgatagatagctttttaaaaaggtatctatcattcttattcttttgataatgaaatgattattaaaatgaatgatacttatgatagatgttttttcactatgtagtatttaatttaaatccgtacagaaagaaactaagtaattgtagagttataacttgttataggtctatattatataatttcagtttattatataatgtcttccggtcaatgttcagtaattgtgccgctttgctcttgttatttccggtttggcgtagtgcctccaaaatatgttctttttcggtttcttcgttgcgtagtgcaatactggtactatttgatgcaggagtttctaaaagctcggttcccaattccaataaagtaatgaaactgctttgtgccaataaagtcgctcttttgacgatgttcttcatttggcgcaaattccccggccaatgataactcaataaagcctgtgatgctttcgcgtcaaaaccaatcaggtgtttatccagttctttgtttgcttgatcgaggaagaaattggcaaagagtagaatgtcctctttccgctctttcaaatcaggcatccgcagagtaaactcattgatacgatgataaaggtcttcacggaaagtgcctttctcaataccctgttccagattctcattggtggcagacaccagacgaatatctaccgatatttcctgtgtagaacctaccggacgtatttttctctcttgcaaggcacgaagcagttgtatctgcacttcataactaaggtttccgatctcatccagaaagatagtaccaccgttggctgcaacgaaagcacccgttttatcagtcagagcacctgtaaacgaacctttcacatgaccgaaaaactccgaagcagccagttctttggggatagaaccacaatctacggcaataaacggtttatcgtttcgtttgctaagttgatgaatacggtgcgccacatactcttttcctgttccgctggaaccgttgataagtacggacatattggtcggagctaccagacctacataattgtagagctgtttggctgcatcactttctccttccagataagcacgatgattttctgttgaatctttagatgaagtagaagcaccttttttagaagaagatttagcaacgttatgagtagcaggactcttttcagactgcagacattcagaaattttcttcagtaattcttccggatttaccggtttggctatataatcacgtgctcccagtttcattgcctgtacggcggattgtatatccgcatagccagtcatgatgattaaaggaatgtccatgccttgttcattcatccatttcagcagatcgataccttcgtggtcgggtagtcgcaggtctgataaaatcagatcgacgttttggctttcgatatgttttcgggcgcgggcaatattactcactgatgatacttcaaagccctttttgcctagccaggtttttagcatcattccaaaagtgatatcatcttcaacgatcaatatggagctcatcatgtcaggttttgattcttttaagtcacaaaggtaagaggatttaggcgaaagtggtatatttgcaaacttaaattaaataaaagtgttatgaaaaagattctattgatagtattaaccatatcgttttgcggacttactgcctgcaaaaccggaacaaaaaaaggaggagacatggataaagaaacgttggtaaagattgaaacaactttaggagacattgaggtgaaactatacaatgagacaccgaaacatcgtgataattttatcaaactggtgaaggacggagtttatgaaggtacactgtttcaccgtgttatcaaagattttatgattcaggccggtgacccggactcaaaaaatgcgccgaaaggaaaaatgctgggtaccggagacgtaggttataccgttcccgctgaatttgtatatcctaaatatttccataaaaaaggtgccctgtccgctgcccgtcagggagataacgtgaacccgaagaaagaatcttccggttgccagttctatatagtgacaggtaaagtgtataacgactctaccttgctgggtatggaaagccagatgaatgagaataagataaatgttattttcaatacactggcacagaaacacatgaaggaaatctataagatgcggaaagcaaatgatgaaaacggtctttatgatttgcaggaaaaactgtttgcgcaggcacaggaaatggcagccaaacaaccggaatttcatttcactccggaacagattgaagcctatacaacggtgggaggaactccgcatctggatggcgaatatactgtgttcggcgaagtagtgaaaggaatggatattgtggataagatccagcaggtgaaaaccgaccgtagcgaccgtcccgaagaggatgtaaagataacaaaggtgacaatacttgactgaatcgtatgaaaatcaacaggcatattcttgataatgggttacgtctggtacattcgcaggacgaaagtacacagatggttgcccttaatatattatataatgtgggagctcgcgacgaagatcccgagcatactggttttgcccatctgttcgaacatctgatgttcggagggtcggtgaatattcccgattatgacatgccgcttcaactggcgggtggagagaataatgcctggacgaataatgatataaccaattactacctcactgtacctcgtcagaacgtagaaaccggcttttggctggaatctgaccggatgttgagtcttgattttagcgaacggagtctggaggtacagcggggagtagtaatggaagaattcaaacagcgatgtttgaatcagccttatggggatatcggacatcttttgcgtcctctggcttatcagacgcatccttatcaatggcctactatcggaaaagagttgtcgcatattgccaatgctacgctggaagaagtgaaggcattctttttccgtttttatgctcctaataatgctatattagctgtaaccggcaatatctctttcgaagaagcggttgctttgacggaaaaatggttcggctctattcctcgtcgggaagttcctcaacggaacctgccacaagaacaggaacagacggaagaacggcggctgacggtagagagaaatgttcctctcgattctttatttatggcataccacatgcctgcccattgccatccggattattatgcatttgatattttgtcggatgtgttgagcaacggacgttccagccggttgaaccagcgtttggtacaacagaaacaattattttcgagtatagatgcttatatttccggcagtgtagatgcggggttattccatattagtggtaaaccttcggcaggtgtcaccctggaacaggcggaagcggcagtgcgggaagaactggaactgttgcagcaagaattggttgacgaacaggaactggaaaaagtgaagaacaaatttgagtccacccagatattcggcaacatcaattatttgaatgtggcaaccaacctggcttggtacgaattgcttggccgggcggaggacatggaaaaagaggtcgatcgttatcggtctgtcacggctgaacaattgcgggcggtagctcaatctgctttccgtaaggagaacggagtaatactatattataagaaacaacaaaattaaattctccctttttataatctatcagtgaaaggggaaaatccctttgcctgaaaatggagatacgtttaggtaacggaaaagtaaatgagacatatttatagtacatataaagagcattataaagcactaatttttctcggactgccgattgtgatcggtcaaataggagtaatcgttcttggatttgcggatacgttaatgatcgggcatcatagtacgattgagctgggagcagcttccttcgtcaataatgtgttcaatctggcgattattttcagtacgggtttttcgtatgggctgactcccattgtgggaggtttgtatggaacccgccagtatgcccctgcgggacaggctttacgcaacagtttgctggcaaacctgatggttgcattgctgctgactgtctgtatgactgttctttatctaaatatagaacgtctcggacagccggaagaattgattcccctgattaaaccgtattaccttgttttgctcgcttcactagtgtttgtcatgcttttcaatggattcaagcagtttacagacggaattacggatacaaaaaccgctatgtggatattgcttggtggaaatgtcttgaatatcataggaaactatatcctgatttatggaaagctcggattgcccgagttaggtctgttgggagcaggtgtcagcacgctgttctcgcgtatcgtgatggtgattatatttatcatcatctttatgcgtagtccgcgttttgtccgctataagattggctttttccgtttgggatggtcacgagctatatttgggcatttgaatggcctcggatggccggttgcttttcaaatgggaatggagacagcctcttttagtctaagtgcgatcatgatcggttggctgggtactatcgctttggcttctcatcaggttatgctggctatttcgcagtttacatttatgatgtattacggtatgggtgctgctgtagctgttcgtgtcagtaacttcaaaggtcagaatgacatcatcaatgtacgtcgttctgcctatgccggttttcatctgatgatgacattgggcgttgtgctttctttgattgtcttcctttgccggaattacttgggaggctggtttaccgacagtcaggaagtggctgctatggtgacctctctaatcttccctttcctcgtttaccagtttggcgacggactgcagattactttcgccaacgctttgcgtggaatttcagatgtaaaactaatgatggtgattgcctttgtcgcctatttcattatttctcttcctgtaggttatttctgcggctttgtcatgggatggggagtagtaggtgtctggatggcatttccttttggtttgacgagcgcaggattgatgctttggtggcgttttcatcacatgacgaaactccccgaacctcaccccaaaacctgatgctaaatacttgataattaaaacttaatacttaaccccaatggcttccttccgttttacaaagttgaaaataaccgccggttacactttgttgctggcgatcctccttttctcgctggtgtttgtacatcgtgagatggaagcattgtcggccgccgacgatcaacagaatttaagaacagacagtttattgacccttctccatgagaaagatcaaaacacgattcagatgttgcgggtgctaagtgaggcaaacgacagccttctctctgcttcggaaatcgaagaaatcatatccgaacaggattctgtgattacccagcaacgggtacaacatcgggtcatcaccaaacgtgactcgttaatcactactcctaaaaagaagggattcttcaaacgactcgccgaagtgttttccccttctaaacaagacagtgccgtattagtaaatacatcgttggaagtagccactgataccattctccaaccgaccacttctaaagattctcttcagcagaaaatccgcatggctaccgaagaaaaacggttgcaacggaggaaaacaatccgacgtaccagtacaaagtaccagcggatgaatacgcagttgacggcacggatggatagcttgattaaacagtatgaggaagaaatgaccttgcgtgcccgtcaggatgccgaacttcagcaggaagtgaggatgcggtcggcacgtatcatcggcggtatcgcggttggtgccgtactattatcggcttttttcctgatattgattatgcgggatatttcccgtagcaaccgttaccgccagcaattggaggtggcgaataaacgggcggaagatttgctgatcgcccgtgaaaaattaatgcttgccattacccatgattttaaagctccgttaggctcaattatgggatataccgaacttctgtcccgattgacagaagatgaacggcaacgattctacctcgacaatatgaaaagctcttcagaacatttattgaagttagttagtgacttgcttgatttccaccggcttgatctcaataaagcggaagtgaatcgcgtaacctttaacccttcccagctatttgatgaaatttatgtcagtttcgaacctttgaccgctgccaaaggtttagccttgcaatgtcacgttgtcccggaactgaatggaagatatatcagtgatcctttgcgactccggcaaattgtgaataaccttttgtccaatgccgtaaaatttactcaaaaaggcgagatcagtctgacagccggttatgattcttcaaagttaaccattgccatagccgatacaggaaaaggaatggcgttagaagatcgtgaacgcattttccaggagtttacacgtctttccggtgcacagggggaagaaggattcgggcttggattgtctattgtgaagaagctggttaccttacttgagggaacaattgacgtgcaaagcacattaggaaaagggagctgttttactgtaactttacctctttatccggtaggtaaatccattgcggaaagcgaatctccggaaaatgaatcttcggaggacgaaagtccatacgctcccaaacagtcggttgccattcctcccatgaaagtcattcgtgtgcttttgattgatgacgataagattcagctgaatctgactgctgccatgttgaaacagcatggtattgatgccgtatgttgtgaacagctggaacagctgattgaacaacttcgctcttccgtcttcgatgtattgctgacagatatacaaatgcctgccattaacgggtttgagctggtaaaactattacgggcttctaatataccacaagcaaaaacaatccctgttattgctgtgactgcccgtagtgaaatggataaagccgctttacatgaacatggttttgccggttgtttgcataaaccgtttacagtaaaggaattgttgctaacagtaaatgaaggtcaactttcggccgatgaagcgcatataacagaagatatgggaactgtcgggatcaacttttctgcactgactgcttattctgaagatgatccggaagcagcatactccatcattcacacttttattgaagagacaggcaagaatgtcgaacggatgcaacaagcattgaatgaaaaagaagtggacgggatagctgccatggcgcataaacttctccctcttttcacaatgatcggagcggaggaaactatcgccccgttaaaatggttggaggcttgtcgtggagaagaattttcggaaaaaatagaagaaacaacattcaatacattagaagctgtccgtaaaataattagtgaagcggagcattatttggaggtaatgaagaatacccaataagccgttttcttctactccttggctactatctgtatctttcttactattacccaaaccttttttcaaaataatttgtttactttgtgtcaccttatttacactgacacattttacatgaaacgaaaatggatacgttgggtaagctggatattgcttactcctataatactctttgtaatactaatggtattgctttatgttcctcccgttcagaatcttttgcgtcgggaggttactgcatacgcttctaaagcaaccggcatgcagattcaggtggagcggatagaccttcgtttcccgcttaatctgttggtacgtggcgtggaggttattcaacagccggatacccttttgtctttggaaagtctcaatgttcgtgtacaggcatggccgttgataaaaggaaaagtagaagtggatgaagtcactttgagccgggtagccgttaattcagccgatttgatggagggaatgaagattaaaggcgttttgggacgtttcttcctgcaaagtcatggcgtcgatctgtctaatgaactagcggtaatcaatcaggtcgaactatccgacactcacgtgcagctactgatgaatgataccacaactacgcccaaagataccacagcttctgctccgatcaactggaaagtagctcttcatcagttgaaattgaaaaatgtatcgttcagtatgcaacttcctgctgattccatgcgtatggcggcccatattggagaagcggccatcgatgatgctcaagcagatttgaagaatcagtactacgacttgaagaagttcttattatcgggaacctccgccagctatgataccggaactgctcaaccggcagagggcttcgacgcttctcatattgccgtccgggatattcgcatcgctctggattccttgctgtataaagggagggatatgaacgcagtcattcgtgagtttaccatgaacgaacgttccggattgagcgtcacttccctgacgggtagagcctactccaatgattcagttatctgtgttcctggtttgaaactgaacactccccattctgaaattgatttatctgcccatacctattgggaactggtcaatatccccactacgggacgcttatccgcccgtctcaatgcttatatcggcaaagaagacgtcatgctgtttgccggcggtctgcccgaaagcttcaaagaagcctatccatttcgtccgctcgtcatccgtgccggcacggacggcaatctgaaagaaatgcagatttcccgtttcacggtagacctgccgggtgcttttgcattggagggcggtggccttttggaaaacctcaccgacagcctcacacgcaccggaaccatcggcctgaaaatgactactcaaaacctgaacttcctgaccgctctgtcgggagaagcgcctaatggtacgcttgtcattcctgacagcatgaatctggtggcgaaagtggatatcaaaggtcctgaatataaagcaaatctccgtttgaaagaaggacaaggagctatggacgtgaatgcagccttaaataccactaccgaagtctataaggctgatttgaaaatagacaatctgcaacttcatagtttcctcccgaaagactctatctatgaactttctctttcggctgcggctaatggtcgtggattagatgtcatgtcctaccattcatttgccaaattgaatctttcattagatcagcttcattatgctaaataccatctttccaatcttgatctgacgggagaacttaaaggcgcattggtcactgcacatctgacaagtgacaatgctttattgaaaatgacaacggatgctgaatacaatctggcacacagctaccccgatggtaaaataacgattgatgtcacccaactggatttgcatgaactgggaatcatgccggaaccaatgaagcgtccgctgactttcaatttttcggcagaggctcgtcagaaccgcgtatttacccatttaatctccggagatatgaaactcgacttgagcgcacgctccggtgttaatcctttgattcgccagtctactcattttgtggatgtgctgatgaagcagattgatgagaaagccttgaatcacgctgaattacgcaaagcattgccaactgctattttctctttctccgcaggacaagagaaccctttggcatatttcctggctaccaagaagatagcttaccatgacgcttcagtgaaattcggaacggctcccaactggggaattaatggaaaagccgctatccacgccttgaaagtagataccttgcaattggataccatcttctttaccgtcaaacaagataccacactcatgaaattgcgtgccggagttattaacggtcccaagaatccgcaattctccttctctaccacactgacgggagagattcgtgatcgggatgccgaattgctggtagactttaagaatggaaaaggagaaacaggagtattactcggtgtcaatgcacgtcccttgttcgagggcaaaggaaaaggcgatggactggctttcaccttgattccggaagaaccgataatcgccttccagaagttccatttcaatgaaaatcataattggatttatgtgcataagaatatgcgtgtatacgccaatgtagatatgtgggatgacgaaggaatgggattccgtgtacattctgtacggggagacaccgtttctctacagaatattgatgtggaaatccgaagaatcagtttggctgatttgagcagtgtacttccttacttcccggaaataaccggtttattctctgcggaagcgcactatgtccagaccgaaaaggatcttcaactttcggttgaagcagctattgatgaattgacttatgaacgtcaacgaattggtgacgtgacagtgggagccacctggctgccaggcgaacagggaaaacaatacctgaacgcctatctgaatcatgacaaagtggaagtgatggtggcggatggtaagctggttccaacccagacaggaaaagacagtctggaagtaaacgctactctggagcatttcccgctacgtgtagctaacgtatttattcctgataaaatggctacgctggccggtgatatggatggtaatctgaatattgcgggtagcaccgagcagcctttgataaatggcgaactgatattggatagcgtttctgtcctttcccgccaatatggtgctaatttcaggttcgacgaccgtccggtacagataaagaataatcggttggaatttgataaattcgctatctatacaactggaaaaactccattcacgattgacggatctgttgatttcagggatatgtcccggccgatggcaaatttgaatctgctggcgcagaactatacgcttttggatgccaaacgtactcgcgaaagtctggtctacggaaaagtatatgctgatttccgggcaacggtgaaaggtccgttagacggattgaacatgcgtggaaatatgagcctgctgggtaatactgacgtttcctatatcttgaccgactcaccgttgacggtacaggatcgtttgggaaatctggtaacctttacttcgtttagcgacaccactacggttgtccaacaagaagtgccgactgtttctttaggcgggttggacatggtgatgatggtacatatcgatccatccgtccgtttgaaagtcgatttggatgcaagcaatgacaatcgtgtcgaactggaagggggaggtgacctctctatgaaatatactccgcaaggtgatctgacattgaccggacgctatacgatgagcggcggtttgatgaaatatgctttacctgtcattgctgccaaagaatttgctatcgataacggtagctatgtggaatggacaggaaaccccatggacccgatgttgaacttcaaagccaccgatcgtatccgtgcttctgtttccgaaggagagaacggcggaacacgttcggttaatttcgatgtgtccattgtcgtcaagaatcggttggataatctttcctttgcatttgatgtatctgctcccgaagatgcaaccatacaaaacgagttgacagccatgggggcggaagagagaggtaaacaagccctctatattatggttatgaaaacctatcttggcaccggaccgattggtggcggaggtggtggattgggtaaactgaatatgggttccgcactgaactccgtattaagcagccaaatcaactcattgatgggaaatttgaaaaatgccagtgtttctgtcggtatcgaagatcacgatttgtcggatacgggtggtaagcgtacggattacagtttccgttattcacaacgtctctttaacaaccgtttccagattgtaatcggaggtaaggtgtctacaggtgagaatgcgacgaatgatgcggaatcctttatcgataacatctctctggaatatcgtttggatagaaccggaacccgttatgttcgtctgttctacgataaaaactacgagagtgtactcgaaggcgagattacggaaacaggagtcggtctggtacttcgcaagaaactggacaaactcagtgaactgttcatctttaagaaaaagaagtaagcatgaaagggatatataataacatattagcaagttgtctgattggtatcattttgttttcgggctgttcggtgacaaaacacctgcctgaaggggaggtactttatacaggaggaaaaacggtggtagagaataagtcggcaacaccggtaggagagacggctttaacagagattgatgcggctcttgacaaaactcccagtacaaagatgttgggagggtttctgcctattccttttaagatgtggatgtataatagctttgtaaaatacgaaaaagggttgggtaaatggttattcaatcgtttggctgccaatcctccggtatttatttccactgttaatccggaagtccgcatcaaggtggctacaaacttactccgtgattatggttacttcaatgggaaagtgacttatgaaacattggttgataagaaagacagcctgaaagcaagtatcctgtatacggtagacatgaagaatccttattttatagatacggtttattatcagcgtttcactccccaaacgttgcgcattatggaacggggacgtcgaatgtcttatataagtcccggcgagcagtttaacgtggtcgatctggatgaagagcgtacccgtatcagtacgctgttgcgtaaccggggatatttttacttccgtcccgattatatgacttatcaggcagatacgacattggttcccggtggacatatcagccttcgtctgattcccgttccgggattacccgctgcggcacaacgtccttactatgtaggagatgcctctgtttacctgtttggcaagaatggtgaggcgcccaatgacagcatgatgtataagaatctgaatatacattattataagaaattgcaggtacgtccgaatatgctttatcgttggttgaactatcaacagtttgtgcggaatgcacagatgcgggcttccaatcgtacccgtctttacagtcagtatcgacaggagcaggtgcaggagaaacttagccagttgggaatcttcagttatctggatttgcaatatgccccgaaagatacgacagccgtttgtgatacgctgaacgtaaccatgcaggccacatttgccaagccgctggacgccgaactggaattgaatgtcgtaaccaaaagtaacgaccaaaccgggcccggagcatcattcggtgtcacccggaacaatgtattcggaggtggcgaaagctggaacgtgaagctgaaaggctcttatgaatggcaaaccggcggaggagaaaaaagctctttgatgaacagctgggagatgggagtttctacctctctgactttcccgcgcgtggttttcccgcattgggggaaaagggagtttgactttccggctaccactacattccgtctatacattgaccagttgaaccgtgccaggtattataaactgttgtcattcggcggaaatgctacctacgatttccagccgacacgtacaagccggcatagtatcacccctttcaaactgacattcaacgtcctgcaacaccaatcggaagaattcagggaaattgccgatgccaatcctgcattatatatcagtttgaaagaccagtttattcctgctatggaatatacctatacctatgataatgcttccgcacgcggtattaaaaatccgatttggtggcaatcgactgtaacctctgccggtaacctgacctcggtgatttaccgtgctttcggtcagtctttcaacaaagaggacaaacgtttgctgaacgtccctttcgcgcagtttgtgaaactgaatacggaattccgccatttgtggaatatggacaagaataataagattgcttcccgtgtagctttgggcgctctcttcgcctacggtaatgcaacgatagccccttacagcgaacaattctatgtgggtggtgccaacagcatccgcgctttcacagtacgtagcatcggcccgggcggataccatccggcagaaagccgctattcttacctcgaccagacgggtactttccgttttgaggcaaatgtagaataccgtttccgtatctttaaaagtttttggggagccactttcctggatgcgggaaacgtttggctgatgcgcaaggatgaggcccgtcccaattcacaactcgaactgaaaacgttcccgaaacaaatcgctttgggcaccggtgtcggtattcgttatgatatggatattcttgtgttccgtcttgatttcggtattcctttgcatctgccttacgatacagaacgaagcggatattacaatgtcacaggatcctttatgaagaatctgggaatacattttgctatcggttatcccttctaatgaatgatttttgtacgattttggtaaataatgattgatatttgtcctgttggattcaactatttttgtaattttgcaacgaaatctgatgccgttgacatcactaaccttttaatattacacaatttatgaaaccaactttattcttattggcagccggtatgggtagccgttatggaggcttgaagcaattagacggactgggtcctaatggcgaaactattatggattactcaatctatgatgctatcaatgccggatttggcaaacttgtatttgtaatccgcaaagattttgaacaagatttccgtgataaaattatttccaaatacgaaggtcacattccttgcgaactggtatttcaatcaatcgacgatcttccggaaggctttacttgcccggcagaccgtaccaaaccttggggtactaaccatgcagtaatgatgggcgctgatgtgattaaggaaccgtttgcagtgatcaactgtgatgacttctatggtcgtgattctttccaggtaatgggcaaattcctttctgctcttcctgaaaattcaaagaacgtttattcgatggtaggtttccgtgtaggaaatacattgagcgaaagcggtacggtatctcgtggtatctgtagtacagatgctaaaggattgttgacatctgtagtagaacgtacgaagattcaacgtctggacggtgaagtgaaatatatcggtgatgatggcgaatggacggctactcccgatacgactccggtaagtatgaacttctggggcttcactcctgattacttcgcttacagccaggaattcttcaagactttcctaagcgatccgaagaatatggaaaacctgaagagcgagttcttcatcccattgatggtagataaattgattaatgacggaactgccactgttgaagtactggatactaccagcaagtggttcggcgtcacttatccggaagaccgtcagagcgtagtagacaagattcaggcattggtagatgccggtgaatatcctgctaagttgttctaaagaagagccatcgattaagatagagagcagtcattcataagaatgactgctttttttgtttttcataacgtatcatactaagtagtatctaataaatattcagtatctttgcagtccaaaatgttataaatcagaagcagaagtgatttcagtagaaggattatcagtagaatttaatgcgacgccgctttttgaggacgtcagctatgtaattaataagaaagaccgcattgcattggtcggcaaaaatggtgccggcaaatcaaccatgctgaagatattggcaggtttgcagtcaccgacacgcggagtggtagctactccgaaagatgtaaccataggatatttgccacaggtcatgattctttccgacaaccggacggtgatgggagaggcagaactggcattcgaacatatatttgagcttcaggcgaagttggaacggatgaatcaggaattggccgaacggacagactatgattcggaagaatatcatcagttgatagaccgtttcacgcatgaaaacgaccggttcctgatgatgggcggtacgaactttcaggcggaaatcgaacggacacttctcggattgggattcagtcgggaagattttgaacgccctacttcggagttttccggtggatggcgtatgcgtatcgaattggcaaaattgctcttacgacgcccggacgtgcttttgctcgatgagccgaccaatcaccttgatattgaaagtatccaatggttggaaaactttttgtctacacgtgccaatgcagtcgtattagtcagccatgaccgtgctttcctgaataacgtaacgacccgcaccatcgaaattacttgcggtcagatttacgactacaaagtgaagtacgatgagtttgtagtcctgcgtaaagaacgccgtgaacaacagctccgtgcttacgaaaatcagcagaaacaaatacaagatacggaagattttatcgaacgcttccgctataaagcaacgaaagccgtacaggtgcaaagccgtatcaagcaactggaaaagatagaccgcatcgaagtggacgaggaagataattccgccttgcgtttaaaattccctccagccagtcgtagcggaaactatcctgtgatttgcgaagatgtgcgcaaagcgtatggcagccatgtcgttttccatgatgtcaacctgactatcaacaggggagagaaagtggctttcgtcggaaagaacggagagggtaagtctaccttggtgaaatgtatcatggacgagattgatttcgaaggcaaactaacgatcggacataatgtacaaatcggttattttgcgcagaaccaggcacaaatgttggatgagaacctgactgtattcgatacgattgaccgggtagcgacaggagatatccgtctgaagatacgtgatatactgggagctttcatgtttggaggcgaagcttcggataaaaaggtgaaagtcctttccggaggagaacgtacgcgattggcgatgattaaacttctgctggaacccgtaaacctactgattctggacgaaccgaccaatcatttggatatgcgttcgaaagatgttttgaaggaagctatccgcgaatttgacggaacagtgattcttgtcagccacgaccgtgattttttggatggacttgcgactaaagtatatgagttcggtggtggacttgtaaaagaacatcttggaggtatctatgaattcttgcaaaagaaaaagatagatagcttgaacgagcttcagaaaggagcgggactgtcggcttctcccacggcttcagctaaaggtaatgaacctgaaaccgttcagccttcggagaataagctctcttacgaagcccagaaagaacttaataagaagattaagaaactcgaacgccaggtggcggactgtgaagcttcaatagaggaaaccgaatccgcgattgctatcgtagaaacgaagatggcaactcccgaaggagcttcggatatgcagctctatgaacggcatcaaaaactgaagcaacagttggatggcattgttgaagagtgggagcgggtttcgatggaactggaagaagcgaaaaactagaacaaaacgcatacttccgagcactatgtgagagaaatgctatacctcgatagaaggtattcctggcgggtatctgtttctcggtgtcgaaacaggtgtttctcgttgaggaacgaggcgttcctcggtgtcggtcaccttcttcctcggtgccggactgcgggtaggatgattgttgattagagagactatttaattatttatacaatatgaaagtaaccaagtatttaccaattcttgccgtatgccttatgacaacaggatgtaacagtaagaaagaggccgtgctgacgtccggtatcgaccttgctaatctggataccacggctatgccgggtacaagtttttatcaatatgcctgtggaggttgggtgaaagatcatccgctgacagacgagtattcacgtttcggtacattcgacatgttgcgcgaaaacagtcgtgaacaactgaaagcattgattgccgaattggcagcgaagaaagataacgcaccgggcagtgctgcgcagaaagtaggtgatctttataatatcgcaatggatagcgtgaagctgaatcaggaaggtgtagctccgatcaaagcagaactggcagccattgacgctctcaaggataaaggagaaatctacgcatatatcgcagagagccagaagaaaggcatccgtccttacttcaccatgtttgtaagtgcggatgatatgaacagttccatgaatatcgtacagacctatcaaggcggtatcggaatgggacagcgtgactattatctggagaatgacgagcagactaaaaatatccgtaataaatatcaggaacatatcgccaaaatgttccagttggcaggttatgatgaggctactgcacagaaagctgtgaaagcagtgatgaacatcgaaactcgcctggcgaaagcggctcgttcacaagtggaattacgtgatcctcatgctaattataacaagatggatagggcgacgctgaaaaagaacttccctacttttgactgggatacttatttcaccgtttccggtttgaaagatttggaagaagtgaatataggtcagccggctgccatgaaggaagtagccgatgtgattaataccgtatcactggacgatcagaaattgtacctccaatggggattgatagatgctgccgcttcttatctaagcgatgattttgaagcacaaaacttcgacttctacagtaggacaatgtctggtaagaaagaaatgcaacctcgctggaaacgttccgtgagcaccgtagatggtgtacttggcgaagtggtaggacagatgtatgtagagaagtacttcccggctgctgccaaagaacgtatggttacactggtgaagaacctgcaaacttctttgggagaacgtatcaaaggtttggaatggatgagtgaaccgaccaaagaaaaagcgttggagaaactggcaaccttccatgtaaaaataggttatcctgataaatggaaagattactccgcactggagatcaaagatgattcttactgggcaaatatcgagcgtgccaacgaatgggattacaacgaaatgattgccaaagccggcaaaccggtagacaaggatgaatggttgatgactcctcaaacagtgaacgcttattataacccgactaccaatgaaatctgcttcccggcagctatcctgcaacctccgttcttcgatatgaatgcggacgatgctatgaactacggtgcaatcggcgtggtaatcggccatgagatgactcatggatttgacgatcagggacgtcaatatgacaaagacggaaacctgaaagactggtggacagaagaagatgctaaaaagttcgaagaacgggcacaggtgatggttaacttctttgacagtattgaagtagctccgggcgtacacgcaaacggtagcctgacacttggagagaacattgccgaccacggaggtttgcaagtatctttccaggcattcaagaatgcaacagaagccgcaccgctggaaattgttgacggatttactccggaacaacgtttcttcctggcttacgctaatgtgtgggcaggaaatatccgtccggaagagattctccgattaaccaaacttgatcctcactcattaggcaaatggcgtgtggacggtgctcttcctcatatccagaattggtatgaagcattcaaaatcaccgaacaggattcgatgttcgtacctaaagaaaaacgagtatctatctggtaatagtttttgaatagatagcatatatgcgaagaggcgttgattttccgttgaggagagtcaacgcttttttttattaattcacaccttatttattacgtacgataaacaatatttcgtaactttgcacaccaaatacttaataagcaattcaatgtcagagtctaaaagaataaaaactgcattggtatctgtataccataaagaaggtttggatgaaattattaccaaacttcatgaagagggagtagagtttttgtcaacaggcggaactcgtcagtttattgaatcattgggatatccttgcaaggcagtggaagatttgaccacttatccttctattctcggtggtagagtaaagacattacatccgaaaattttcggaggtattctttgtcgtcgcggcctggaacaggatatgcaacagattgagaaatatgaaattcccgagatagatctggttattgttgatttgtatccgttcgaagctaccgtagcttccggtgcatctgaagcagacattattgaaaaaatcgatataggcggaatctcactgattcgtgccgcagccaagaactacaacgatgtaatcatcgtagcttctcaagctcaatacaaaccattattggatatgttgatggagcatggcgctacttcttcactcgaagaacgtcgctggatggctaaagaagcatttgccgtttcttctcactacgattcggctattttcaactatttcgatgccggcgaaggttctgctttccgttgctctgttaatagccagaagcaacttcgttacggtgaaaacccacatcagaaaggttatttctacggaaatctggaagcaatgttcgaccagattcacggaaaagaaatctcttataacaatcttctcgacatcaacgcagccgttgacctgatcgacgaattcgatgacctcactttcgctatcctgaaacataacaacgcttgcggattagcttcccgtgctacagttttggaagcttggaaagatgcattggccggtgatccggtttctgctttcggaggtgtattgattacgaatggtgtcatcgacaaagaagctgcggaagaaatcaacaagattttcttcgaagtgattatcgcgccggattatgatgtggatgcactcgaaatcctgggacagaaaaagaaccgcatcatcctcgttcgtaaggaagctaaattgcctaagaaacaattccgtgctttgctgaatggcgtattggtgcaggataaagatactaatattgaaacggtagccgacctgaaaaccgtgacagacaaagctcctactccggaagaagtggaagatatgttgtttgccaacaaaattgtaaagaacagcaaatccaacgccatcgtattggcaaaggataaacaacttcttgcaagcggtgtaggacagacttcacgtgtagacgcattgaaacaagcaattgaaaaagccaaatcattcggtttcgacctgaatggtgcagtcatggcttccgatgccttcttcccgttccccgattgtgtggaaattgcagataaagaaggtattacggctgttatccaaccgggaggttcggtaaaagacgatttatcatttgcttattgcaatgagcacggtatggcgatggtgactaccggtatccgtcattttaaacactaaagcgatttactatttgacaatttacaatttactattcagccgttcggcaatatggatttgattgtcagatagtaataagtatgtatcaaatagtaaatagtaaattgtcaaatagtaaataaaaaaatgggattattttcttttacacaagagatagcaatggacttgggcacagccaatactatcatcatcacgaacggaaaaatcgtggtggatgagccttcggttgtagctctggatcgccgtacagaaaagatgattgccgtgggggaaaaggcgaagttgatgcatgaaaaaacccacgaaaacatacgtaccatccgtccgttgagagacggagtgattgccgacttctatgcttgcgagcagatgatgcgcggtttgataaagcaggtgaatactcgcaaccatttgttttcaccttctcttcgcatggtgattggtgttccttcgggaagtacggaagtcgaactccgtgctgtccgtgactctgcggaacatgccggcggtcgtgatgtttatttgattttcgagccgatggctgcggcaatcggtatcggcatcgatgtggaagctccggaaggaaacatgattgtcgatataggtggtggatctacggaaattgccgttatctctttgggaggtatcgtttccaacaactccatccgcacagccggtgatgacctgacagaggatattcgcgaatatatgagccgtcagcacaatgtgaaagtcagcgagcgtatggcagaacgtatcaaaatcaatgtaggtgctgctttaaccgaactgggtgatgatgctccggaagattatatcgttcacggtccgaaccgtatcacggctcttccgatggaagtgcctgtatgctaccaggaagtagcccactgtctggagaaatcaatttcaaagatcgaaactgctatcttgagtgcattggaaaatacacctcctgaactgtatgctgatattgtgcacaatggtatctatctctccggaggtggtgcattgcttcgcggactggataagagattgaccgataagatcaacattcctttccatattgcggaagatcctttgcatgcagttgccaaaggtacaggagtggcattgaagaacgtagaccgtttctctttcttaatgagataaaccggggatgaggaatttattaaacttccttctgaaatacaattactggttcctcttcatcttattggaggtagccagttttgttttgttatttcggttcaaccgttatcagcagagtgcattcttcacttctgccaatacggttgtgggggcagtttatgaagtttcgggagggatttcctcttattttcatctgaaatcggtcaacgaagatctattggatcgcaacatggtgctcgaacaacagatcactaatctggaaaaagcattgagagagcagcagctcgattctatggcaatcaacagcatccggcaggtgccgcaagcggattatcagttgtttaaagcgcatgtgataaagaacagtttgaatctggttgataattatattacgctcgataaaggttcctcttccggtattcgctccgaaatgggagtggtggatggtaatgggattgtagggattgtttatgaaacctctccttcctactcggtggtgatttcggtactgaacagcaagtcgaatatcagttgcaagattatcggcagtgattatttcggctacctgaaatgggaacatggagattcgcgctatgcttatctgaaagacttgcctcgtcatgcagagtttaatttgggagatacagtcgttaccagtggtttctccaccgtctttcccgaaggtataatggtggggacggtagatgatatgtccgactctaatgacggactttcctatctgttgaaaatcaagctggctactgatttcggtaagttgagtgacgttcgggtggtagcccggacaggtcaggaagaacagaagaaacttgaaaataaggtgatgaaagaatgattattacttatatacatagaatcggatggtttatcggcttggtacttcttcaggtgctaatccttaatagtgtacatattgccggctatgctactccttttctctatatctattttattctgaaattcagctccggcacttcccggaatgaactgatgttgtgggcttttttcttcgggctgaccattgatatattctccgatactccgggaatgaatgcggcagctaccgtattgcttgcctttctccgtccctctttgcttcgtctgttcatgccccgtgataatccggacagccttattccctctttcaagacgatgggaatcagtcctttcttaaaatatactactgcaagtgtttttgtgcacagtctggcattactctccattgagttcttctcatttaccagcatttggctgttactgttgcgagtgcttctttgcactattctgactgtaacctgtatcatagctatagaagggattaagaagtaacgatggcaaaagattatatcttagagaagcgtaaatttgtaatcggaggcattgctatctccattgttttgatttatctgatacgtctttttgtattgcagattacgactgatgactacaagaagaatgctgacagtaacgcttttctgaataagatccaatacccctcgcgtggtgctatttatgaccggaccggtaaactattggtattcaaccagccggcatacgacataacgatcgtgccaaaggaaatagagaatctggacacactcgatttatgccaatcgctgaatatcacccgtgcgcagtttctcaaaataatgagcgacatgaaagaccgtcgccgcaatccggggtattcccgctataccaaccagttgtttatgtcgcaactttcggcggaagaatgtggtgtctttcaggaaaagctgtttaagtttcgtggcttttatatccaacggcgtaccattcgtcaatattcgtacaatgctgccgcccatgctttgggagatataggagaagtctccgcaaaagaaatggaagcggatgaagaaggatactacatccgtggggattatgtcggcaagttaggagtcgagaaatcgtatgaaaagtaccttcgtggcgagaaaggaattgagattctgcttcgtgatgcacacggtcgtatccaagggcattatatggatggtgaatatgaccgtccttccgttcccggcaagaacctgacattgagtctggatattgacttgcagatgctgggcgaacgtttattaaagaataagattggaagtatcgtggctatcgaaccggagaccggagaaatcctttgtctggtatcctctcccaattatgacccgcatttgatgattggccgccagcgtggtaagaatcatctggctttgcaacgtgatatgactaaaccgcttttgaatcgtgccctgatgggagtgtatcctccgggatctacgttcaagacagcgcaaggactgacgttcctgcaagaaggaatcatcactgaacaaagtccggcattcccttgttcacatgggttccattacggaagattgacagtaggctgccatgctcacgggtctcccttgccattgattccggctattgctacatcgtgcaactcctatttctgttggggattgttccgtatgtttagcgaccgtaaatacggttcgccgcaaaacgccattacggtctggaaagaccacatggtttcgcaaggatttggctacaaactgggagttgatttgccgggagagaaacgggggctgattccgaatgcgcagttctacgataaagcctatcgcggacattggaacggactgacagtaatcagtatctctatcggacagggggaaattttatccactccccttcagattgctaatttgggagcaaccatagctaacagaggatactttgtgacaccgcatattgtaaaggaaatccaagataatcagttggacagcatctatcgcgtaccacgctataccactattgagaaaagacattatgaatcagtcgtagaagggatgcgtggcgcagctaccggaggaacttgtcgtatgctgtcagtgatggttccggatttggaagcctgtggaaaaacgggtactgcgcagaaccgcggacacgaccactcggtatttatgggctttgcgccgatgaacaaaccgaagatagctattgccgtctatgtagagaacggcggatggggggctacttacggagttcctttcggcgcactgatgatggaacagtatttgaaaggcaagctctcgccggagaacgagttgagggcggaagaatttagtaacagagtgatattatatggtaacgaggaacgatagtttgtggaaaacgctggactgggtaacgatttttatttacctgctcctgattgttggcggatggtttagcgtctgcggagccagctatgactatggcgaacgcgacttcctcgacttctcgacccgtgccggcaagcaattcgtgtggattatctgttccttcgggctcggattcgtgctattgatgctggaagaccgtatgtatgatatgttcgcgtacattatatatgtggggatgattctcttgctcattgttaccatcttcatagcaccggacaccaaaggatcacgctcctggcttgtcatggggcctgtgagcctgcaacccgccgagtttgccaagttcgctacggccttggcgttggctaaatacatgaattcttattcattcagtatcaagaaagaaaagtgtgcctttatcctgggattcatcattcttctcccgatgttattgattatcgggcagcgggagacaggatctgcattggtttatcttgctttttttctggtgctttatcgtgaaggaatgccgggagtagtgctttttgcgggcgtatgtgcggtaatctactttgtggtcggcatccgttttgatgaagtctttatcgccgatactcctacaccactgggagaatttatcgtattactattgatcttattatttgccggtggtatggtgtgggtatatcgcaagaaatggtctgctacccgcaatatcattggtggaagtttggctatattattgattgcttatttaatatccgaatattgggtacattttagcctcgtttgggtgcaatgggcgctttgtattatggtgataggctatctgatttatttggcattaagtgagcggcaacgtacttatttcctgattgccctgtttacaatcggttctgtcggcttcctgtattccagtaactatgtatttgataatgtgctcgaacctcaccagcaagtccgtatcaaagtagtgctcggtttggaagaagatttgaccggtgccggatacaacgtgaatcagtccaagattgccattggttccggtgggttgacaggaaaaggattcctgaatggtacgcaaacaaaattaaagtacgtgcccgaacaggataccgactttatattctgtacagtaggtgaggagcaaggatttgtcggttcggctgctgtcctgttggctttccttattttgatcttacgattaatcttcctgtccgaacggcagacttccaactttgggcgggtttatggatattcggttgtcagtattttccttttccacttatttattaatatcggtatggtgctggggttaactccggttatcggtattccattgcctttcttcagctatggaggttcttctttatggggatttacgatattgctgtttatcttcctgcgtattgatgcaggacgtggcagaagactctaatcttactgcttctcaatacggatacctacatcgctcaatccttgtaacttttcatctttcattccgctcataattttaatagtataatttgcaggatgtaaagggcgaacagatgtaataaaagtttccgattggtaaatgcttccccatccgtgtcccgtccatcttccggtagagtcagccaggcagaaagcaatggtatcagtgcgccataccgtagaatcctgtagattctgactgataaataaatggaggttatgataaggatattcgatactgttgcggacttccgcaaaaagccggagagtagtgggaacgctgtcagttatgggaatctgaaaagagagtgtatcactctttccccatcccttgttgggaagggattgataagagtgatacactgtatgttcattgcaggctgtcagtaagcaagcgctgaatagactcaatatactattcttgagtaggcttttcattagttgactgtttctcctgattctgatttctttccggtctggaaggacgctcgtggttgggacgacgttcttgacgttcctgtccttgctgttcccgttgacggtcttgttgttgcggacgttcctgattcgaccgttcctgtccttgtggacgttcttgatttgatcctctttccggacgtctgttttcgttgttccgtccctggttctgtcctctgttccggttgttgttattgttatttctcgggcggttgtctctttcccctctgttgccgttttcttgctgttgcgggcggttttcattctcccgttgaggttgttgcggacgattgccgccttctgcttgctgttgcgggcggtttccgttattattgtttccttttttcttctttttattattccggttagcgttattgccgccctctttattattccggctgcggtcgaaacgggtaacactttcctgttccagcaaatcaactggttttcttggttccggtttcttttcttcttcgagcaagctgtccggtttcatccctttcttattcatggagattacttcaaacgcacgtttgccgctgatagtgaccagattggctgggaagtttttatccgtagaataagaaacctgattgcttagaatatccgctttgaagaaatagaaagtgccatctttcgtttccaactctatctctcttgaagggagacgtttttgagcttccacataacagtccacctcgtagttcagacagcatttcagcttagcgcactgtccggcaagtttctgcggattcaatgagatatcctgaaaacgggctgcactggtagaaacagagacgaagctcgtcatccatgtagcgcagcaaagttcgcgtccgcaaggaccgatcccgccgatgcgtcctgcttcctgacgggcaccgatttgtttcatttcgatacgtacgcggaatgcttcggccaatactttaatcagttgccggaagtctacccgctcatcggcgatatagtagaaaatagctttgttgccatctccctgatactccacatcaccgattttcatatccagattgagattcaacgcaatctgacgcgcacgaatcatcgtagcgtgttctttggctttggcttcgttgaacttttccatatctaccggcttagctttccgatagacacgcttgatttccgtatctgctttgaagtttgctttcttcatttgcaggggaacgagccggccggtcaatgtaaccacgccgatgtcatggccgggagccgcttcaacggcaactacatctcctttttccagtttaatcttgttgctgttccgaaaatatcccttccgggtattcttgaattgcacttccaccatgtcactctcttctgcattgcccggaatgtccgccagccaatcgtaggtgttcagctttttatcttgtcgggagcatcctttgcagcaaaggccaccgcttccattatgaagtttatattccataagtttatatatttattattgcttcaacagtacaatcatcttcagcgagaagtcgaagaataccattttagcatttacattctgttctatatgtagttgcgcttcgctcagttcgtccatgatacccatcacattccgttcgttgacaaaaggcgcaaagcgggttgcaaaattctgttcattaatcgtcatatacgtcaaattgcgctggtgcaggttgaagacaaagttttcgcggatcatgcgctggcaatattccagaaagtttttctggcgttcgcgtcccatgctggccacctgttcgctccacatcttcatctcctttattttccgttgataggacaagcgcatcaggttgacgaagagctcgaagaataactgattttcctcattcagatgaatcgtttcgagtgccttgacgaaatttccgtttgccagatgggcaatcgaaatgctatccgcaggctgaacatgatatttactctgcaatacccggtcgatgctggcttcgtcaattttccgcacattcatacgttgagtacggctcaaaatggtaggcagaatcatgtccggagcttcggataccaacagaaaaatcgtcttttcgggtggctcctcaagcagtttcagcaacttattggcgcataccgggtgcattttctccggcaaccatacaatcgtaatcttaaatccaccttcactggatttcagactgagcttcttcaggatctcatcgctctctttggcataaatcagcgcttgcgagttctccgcgtccatttcacccaaccaatggttgaggttaaaataaggattgttaataacgaatagccgccaatcggcaatataatcatcgcacacttctttctttcctttcgcacttttcacgatggggaatacgaaatgcacatccggatgtaccagcttattgaatttcacacaagacggacagacaccgcaagcatcttcctcgccccgattggtgcaactgatgtagcgtgcgtatgcgatagccaatggcattttaccaactccctcgggaccgcaaatgagttgggcatgtggaatacgcccctcgttcacttcctgaatgagtcgttgcttgatttcttcttgtccgattacgtctctaaaaaacatatcaataaatgattttggctatttccttgatactgtctactgctccgatagaatagaaatggatgctcggaactccgtgttccatcaactccttgcattgagccacgcaccattcaacacccacctgttcggcttccgcatcattcttgcatttcaatgcttctttcaccagatcttccggtaaatccaccttgaatgttttggggatcatgcttagttgggagattttcttgaaaggcttgattcccggaatgataggaatgttgatacctgctgccttagcctgctccacaaaatcgaaatatttcttattatcgtagaataattgtgtcacagcatactctgcaccagtttctaccttctttttcagccagtaaagatctgtctctatgttaggagattcttcatgcttttccggataacacgccacaccatacgagaaaggactggcggtgactttcatctccgaaccgtcaacgaagattcccttattgaaattattaatctgctcctgcaattcaatcgcatgatgatatccgtctccttcgggagtaaataccgattcatgtttagccttgtctccacggagtaccagcaaatctgttatattcagaaattgcaaatccagcaatacatattcggtctcctcacgcgtgaaaccactgcacaggatatgaggaaccacagtaatattatatttattctgaatggctgccgccacagcgactgttcccggacgccttctcaggcggtttctctgaaagagcccgttgccgagatctttgtagacatattcgctgcgatgcgtggtgatattgatatatttcggatcaaattctcgaagagtgtcgattgtctgatagagcttttcgattccggttcccttcaaaggagggagaatttcgaaagaaaaagctgtacctttactgttatttattaaatcaattactttcattccttttcgttgatgttgttatctacttggattaaacatgcatattgggacaaaaatacgaaaaaagaaagatttcttcttgatttgtttgaaaatagtttggtttttatcgtactattacataaaagagggcatatcctgtatttcggatgcaccctctctcacctaatcattattaaattagaatttacttttcgagaaatgatttcttcattctggcaatgtcagtcagataatcttgtaaatcttgttcatgttcttcctcttcggcaagaatatgtttggcgatatcacaagtggtgaaatctttcccgttagtaaagtcggcaatttcctgataacggagaatggcacagcgttcggaagcaacattatccttcagcaaactgactgaatcgaagccttgcggagcatcatatttgcatcttgccagttcgaaccattgtttcggatcaagtaccggaaccccttccagctcgatgatacggtcggcaagcagctgtgcatgtctacgttcttcttcggcatgttcctcgaactcaccttgtacatcggcacgcatggcgccttccactactaatgcacctacccaatattggtaatatgccaaccactcttcagccaatgctgcgttcaactgtgaaattaaactttctacatctaatttaccttgtaggatttttacactttctctagccataattttaaagtttaggttactatgtttaaatcgctaatgtaacagacggaggttctttttgtttgagtatcccggaggttttaacagaaagaatgcattgcactgtgcagctccttcttttttaatagaacatggatgcttttaatatttcatttcaactaaatttttgtatcacttttaccctcacatcctcacaccttcgctcaattcctttattcatcgtggttacaacgtgtgagggtaagtgcggtagtagggtgagggtaactttttaccctcaccctgtcttgtcctgattctatcttaaacagtttataataagtgtcttgtctattcgcttttatcttatactctcctatacaatagacgtcaatgccttatataatagatgtttatccctcgtgattcttctgataagccctaatgtcttttaacggctcactgcagtgaacgaatttgtttactatcgttagcttatttgtttacatctgatagcttatttgttcactgcagtgagcccttgccaactactaagcaaatggatattgaacataagaagaaagcctatgaagtggcatatcttataaagaaagatacctgtatgctgaaattaggatagtaatttatttattgattagtaggagcgaattataaactaaagtagagtgataacagatagctattctcacttttttatgtgttcttgtcctgtagaaatctattttttagtttgtttctttaagagtacttctctttttaccctctctttgcgaatatctttttgttatttgctctacacgcgcgtatgtaatataataatgtaccatttccggcctgttttcatatagatgtaacatatatgaagaaaaatatgttctacaacatcgttatgattcagtaagttagggcggatatctaaaaataattagaaaaaatagtcagatatatttggatgttatagataagttgtctacttttgcacccgctttgctagagagacagagcctaatgattgacattctgctataagatgaaggccacagaaaataaaaacaaaaaaactttgaaaaaagtttggaggttatctgaaaaagtccttatctttgcatccgctttcgcaaagaaagcaggcgcggcggaagccacgttagttctttgaaatattgataaacaatacaagtagtacaggtaaaaaaatagaaccgtcaatacttgtcttatgaagtagtgatacagttaagactaataggtatttgaataaggtcaataaatttacggcgtcctgaacagagcaaaaagatcatcttaaccgatgataaaaaatacttttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactccggaatagcctttcgaaagaaagattaataccggatagcatacgaatatcgcatgatatttttattaaagaatttcggttatcgatggggatgcgttccattagtttgttggcggggtggtgtaagataaatgtataaaagattaaggaaagagtataatgcgttttccctgtaagccaccgctatctttaccttcccacggccgtggtaacttcttcccacagtcgtgacgagatcctcccacggccgtgaagagatgctaccacggctgtggagagttaaggatagcgtaggtctggtaagcattcggcctcgcccgtatttctctccaagctataataaagtcaaaagccagacgaagcatgtctggcttttgactttatttatctttcttgtttatcctttccaattaaatggcagtaaatcggcgtagtcgtttttcttttctctttcattctcctgtaccctaatcaacacgtcctgcatccatagttttgggttcaccttattttccctgcaacatcccatcagtgaaaagaatattgccgctgcatgtgccgcttcatgtgaaccggagaaaagagtgttttttctgttcaaagtcaatggccttatagagcgctccactggattattgtcaatgcagaactgtgcatcgttgacatatccggacagttgttcaaaacgtgtgtacatatagaatatggccttggcaataggcgatttctcaaccgtatgttcatactcctgcctgcaccatttttccagtcctttgataatagggtacgattcttcccggcgaagccttactacagctccgccttccagatgtcctatcctgattttctcctccacagcatacagtctgcctatttgttcaagtgcatgccttgctctaggaggatcatttccttccgcttccacaaacttgcgcctgacgtgtgcccagcagcacaggtgcaactttccgggtagtgtgtcgaactcatcatatactgcaaagccgtcactctgtaccatccgaacctgtcctgccagcagcgtgtctattccgctgctgccacgtcccttgtgatattcaaagaatggggtatggaaccggggcagatagaagttccacatatacccgcggtgaagagcaccgggccggtcgctttcaagtacgggatggggcgtctcatcggccatgacgtaatagctgtccttgaccagttcacgaagctcattatagattggctccagacgctgtgcggcagccatcatccagttacttacggtagaaggactcagatggatgccttcacgctcaaagatgtccagttgtctgtacagaggcaggtggtcgtaatatttggcggtagcaatgtgtgacagtacactttccgacgcattgctgtggggatgtgccattacgggcatgggagcagttatgatacgaccgtcggcgagccggtatttagggcggatgatgcgtctcacatagaatcgggcgggactgacggcatattgttcgctcacttcctctcccagcttcgccgctccctccaacgaaaggccttccggcatgggaatgataatctcttcacggggaagggacgggtcgatgggcttacgggcgtggggagtaatctttttggtgaagctcttacggaaacggttgtaaccattctccgatttggcagatttctcagctgttttctgttcttccgctaccgggtcattgacatcggacggagactcaaaacagatgctcaactggccggcatcttcgggaagatggcgtttttcactggatttaccccataaacggcgtgtcaagtcagccaatttccatctcaggtcggcaatgacggctgtacaggctgagatttcttcgacctggcgggaatactcccgcaaagaggattcgtattttctctgaagttctgcatgttccttttcaaggcgttcacgttccttgcgcagctcttcgtactcttccaaagtaagggtaatgaccggttctttcactgtatatccacttttttattatgtgacaaagttatcaaaataaagcagaacggcttgtaggacgggagattacttttcaactgttttccgatactttttaacagtaagcagctcattcaggcgattccaggaaatttgaagaaaatccctcttccgttcgtcctttttcaagagaaaagagccgcgattcagacgacggcattccaaacggtattcgtcgtcgcaccgataaaggatatgcaacctgctacgggagcggtcaagaaaaatatggcaactctgctctgacacgcaagaactcgtgtgccggatgacctcgccacaaagaccgtcaatgcctttatggaaattacaaccttggggataaaggtaataggaccagaaaggactgctacggaaaagaccaaggcctaaagggagaagtaggtcctgaggggaatggataccaaggctggaagccgaaactttataacgacgaccaccatcaaatatgaaaagaaccgaatcaaaatggttagactcggaaaaaaggctacgtagtttatcactttcgctagaaaatactaatactgaacacataatggattaagattgtaatgaagacacaaaggtaggaaggaaaagaagggaaacaaacacgcacgtgaccgaatgcttactaggtctgacagaacaataccgattgggtaaattaagtataacggctttataatgcaaacttcatagggacatacgttcttctatcccgtattctatgctgttaatctacaaagagacaggctgacaataaaaagactaaataatatccttatgagtaaaaatgattagaagcggcagcgaagatctaccccaaattgcattgggcgtcctttctgcatgaaacctttgttcattgtttcgaaatagaaggctgcatagtctttattcaggaagttgcgtgcccagaaactaatcattgcgtcaccgatttccagattcgttctccagttgagtgtgccatagaaggattggctgacgtcattttgttcagtccaatagatacgtccggcagcgttatagttcgcttggaacacaacccggtcgaagatagagtgcggactacaggtgatggcatattctccaccgatatttaaggtatgcttggggacgaagggaacatatttgccattgtaatccgtagttatgggagtgccatcttttttctcttcggtgattacataatcagtaaaggtggcatacgtatatccataactggcattcaggctaagttctttagtcacactggcacgaagagcagcttctgcaccataactgcggctttttcccgcattgatggtgatacgtcccaaaccactttctgcaaattgggagagttgttggtcgcgggtatccatgtagaatgctgcgacgtcagcccaaagtctaccttcccatagagtaagatgactacctacttcgtagttccacgaatattcgggtttgtaagtggtggacgcttttacattaatttcttttgcaggcaccatttggtccatcattttaataatagtttctccccatatagcatcttgccctattgtcggactttctttgatggcattcatcatcgaatttttcaattcagtttgtgataaatcagagaacatctggatgttatatcctcccgaacgatatccccgggtaacggtggcataaacattattttgattcttccattcatattgaatagcaaatttgggtagaagttgtacgtaatcagtcgagagcttacctacgaaagaggccggagctttcatattctgatcggacagatttatttgcgtgggacccattgccatgtggaagtcgaaaccaaagtcaataggagtgctaagagaattatacttcatactgattttttcgtaatcgagtcggagtccggctgtaacggacaacccttcgatgaacagattgttgaaagtggactgatgataaagtgcaccgctaagggttggggtatcgaaggttcctcctacgcttaatgtcgggttgtacacggtcattcccatggtgggagctccgggtttggcagagacttcttcaaaagcggaattggcgttgttttcaatgactgacttcactccttcttctttgaacagaacaggacctgtagtgtgtagccattgatagaatccgaaagcgcccgtagcccactgccatctttttccgggtttggctttcaagacaatttcttcggaaatggtgttcgctctctgcttttgttcgatgttgaaaatatccctctctgtgaagtcctgatcgagaaacatacggtcattcaggtgctgataacctgtcacggcacttaatataaagttacaggcttggtattcgatgttaacaccagagttgagcaatccacggcggtaactactacggtcgttatatgaaatcttaccgatgtagtctgcccggtcttctgtcatttctttaccgtctttttgagctttggctatggcactgggagtaataccgatataataatacggatacccaccttgatcgctatattcatagctaagtgccatatctattttcagattagatgtcggtaggtaaattccacgaaaacgtccgcctccggcgttgcttttgtcgaccttttcgttatttcgtgcagaattctcaaagaagccgcctgtatgctcgtagaaacctccggtagaaaaagcaaagcggtcggatgtgcggtgatagtgggtgagtgaaacattataattattgtaagttgctgctcccatgcgaatatcggtaccttgataagtgaaaggagatttagtatgtaccttgataagccctcccatcgtgttacgcccgtagagagtaccttgtggcccgcgaagaatatcaatacgttcgatatcagcatagttgaagtcgaaagcggatttgtcgatataagggatattgtctacataaagtcctacggacggagtattgatgcgtgaaccgattccacggatataaatcgaagtagtcagtttggagccatagtcagggataaacaggttgggaacaatacctgtcaggttcttcacggaatttacctgattggcgcgcatattgtcttgcgataaaacggtggcggctaccggcagatcacgtagtttacggttctcttttggagtagcaatcactaccacctcttcgatgtctactatttttagtgagtctttggggaaatcttcagcccatgctgtccctgtcgtcaggagcatgagggcaatcataatcttctttgtcttcatctgctgttaatttatctggtgcaaagtaacggcaaatatagatgacggtcaatcctcatttattaggattatgacttattttttaagaagtcagattcggtcagcttcgatatatccgttcattacagcataaatagtcagcccggagacggacttaatgcctaatttctccgtgatattttttcggtgagtgataacggtagtcaggctgatattcagtttatctgctatttctttgttgattaatcctttggttatcagtacgagcacttctatttcacgggcggatagaatttcctgatgaggctgcatcggaggcatgggtgacatatcttttaccggataaccgtcatggtgagcatgttggtgaagtttcaatatgtttttcaccaactcttcttcggattcatgaatgttgagtacgggtacgccggacagttggaattgcggactgtcgcttgccaatacaatcgtttttcgtttccgggggagaaagaaagcattgtgctccacgtaaatctgtgcggaaatgaaatagtgggcatacatatcgggagtatcgtccatcagttcgctgaagtgatgaaaagtccgtatggttgccataggaatcatttcctccaggattcctttcagaccgagacaggtcaatgtattggcttctacaattgctatttcgggttgataattcattttagtgtaagtttaattaatgattgaaatagttggctactgcttctgcacatcgttcgccgtccactccggcagacacaattcctccggcatagcctgccccttctccgcacggaaataatccacgaacggtgacatgttgcagagtatccttatcgcgtatgatacgaacgggagaagaagttcgtgtttccacaccaatcattactgcctcattagtcaggaatccgtgactgctgcgtccgaattgttggaaaccaagagataaccttttgctaataaatgatggcatccagaaatgaagtggagacgaaatcaatcccggactataggatgactcgggcaaattgtaactcaatttcttgcgggtaaaatccagcatgcgttgcgccggagcggtctgtcgtctgcctccctgcaaccagcattgacgttccaattcctcttgaaagtgaagaacagatagtaactgtgaattaatctctgaaagttgtgaacttttcaaatttggattcagtgccatcagctgttcatcttgttgggcagccaattcttcattcctcatttttaattcttcatttcccaaatcctccggttgaatttccactaccattcccgaattactccaccgtgacccacggttggcaggagacatgccgtttactaccacttgttccggtccgctggcagcaggaacgataaagccgccgggacacatacagaaactatatactcctctgccttctgcctgtgttacaaagctgtattctgcagcgggcaggtatttgccccgtccattcttattatggtattgtatttgatcgatcaacattgccggatgttcgagacgtaccccgacagcgattcctttcgcttcaatcgtcacattattggcagccagccaacgatatacatctcttgcagaatgtccggttgccagtatcacaggtccgagaaaggtctttcctgtatttgtttcgatacctttgacttcatcgttctcaataatcaatgcatccattcgtgtctggaaatgtacttctccgccacattcgataatggtgttccgcatattttcaatgacacgtggcaatttgtctgttccgatatgcggatgcgcatccaccaatatcgaagttgaagctccatgctggcaaaatacgttcaagattttatccacatttcctctcttcttgctacgggtatagagtttcccatccgagtaagctcctgcacctccttctccgaaactgtaattcgattccggatcaacagtgtgttccctgttgatttgtgccaggtcttttttacgttcgcgcacgtcttttccacgttcgatgacgatagggcgtaacccaagttcaacaaggcgtaaagcagcgaataatccgccgggacctgcgccaacgacaatcacttgcagttttccttctacattattatatatagtacgttcgtactcatcttcttgcggcatttccttgatgtatgcccttaccttcagattgacgaagatagtccgctggcgtgcatcaatactccgtttcaagattcgggtagcggtgatgtcacgtaaattcagacctttttctttagaaagatattcctttaatttctgttcgtttgctgcgatttcgggaagtatacggagttggtattcttgtgtcatttagttattattgatattgttttcgattatccaattagaaaaacgggctatttatgcatcagtgtcttatccgaataaagccctgaacgcctcttctacttttctcaccggtactaattctatcttcagtttttgggtatcgatcccttgcagattatattttggcaacaagaaccgtttaaaacccaatttctcggcttcaccgatacgttgttctattcgattcacaggacgtatctctcccgacaatccgatttctcccgccatgcaaacttccggctcaatggctgcatccatattggaagaaaggattgcactgataaccggcagatcgatagccggatcattcactttcaatcctccggcaatattcaggaacacatctttctgtgccaacttaaatcccacccgcttttcgagaacagccagcagcatattcattcttctcaaatcgaaaccggttgccgaacgttgcggatttccgtagactgcagagcttaccaaagcctgtgtctcaatcaaaaatgggcgaatcccctcaatggcggaggcaatggctaccccgctcatcccttcatgatcctgacttagcaaaagttcggaaggattactcacttggcgcaacccgtcctgacgcatttcataaatacctaattctgccgtactaccgaaacgattcttgatactgcgtagaatacgatacatataatgttggtcgccctcaaattgaagaacagtatctacgatatgttccagcactttaggtcctgcaatacttccttccttattaatatgtccgatcagcaatacaggcgtatgtgtttctttcgcaaaacgaagaatagacgccgaacactctctgacttgcgctatacttccgggagacgattcgatactttcggtggaaatagtctgtatagagtcgataatcactaaatcgggattcgtattcttgatatgcacataaatctgttcgagtgaagtctcgcaaacgatcaggcaatcgctggaagtgtcagagagacggtcggcacgaagtttcagctgtcgtgcactctcttcaccggatacataaagaatcttcttttccggcatgtgcagtacggtctgcatgacgagcgtcgatttaccgattcccggctcgccgcctatcaggacaagagaaccctgtataagtccgcctcccaatacacgattcagttcatcatcgtgcatattgatgcgtggctcgtcgtctgcctctatatcgctaagtgccagtggcttgggcttctgtgtttcaatgcccgacaccggacggcggttagtgggttctttccgtacgatttcttcaacatacgtattccattctccacacgacggacatttacccacccatttcggtgaatcctgtccgcaattactgcatacatatacggttttctcttttgccatcgaaattcctttcttcttgtagggtacaaaaatagggataatttattagaaataagttatccctgcctaatagaaatagatgaagcctacagagttatctctcccgctatcgaacggttcatccggtcgcgtacctcatccggagtatatccatgtcccagtaagaacattaatttagtgactgccgattccgttgtactgtcatatccggagacaacgcctgcctgcaacaactggtatcccgtttcgtaacgttccatttctaccattcctgcgctgcattgtgttacgttgacaatcacaattccacgttcactggcctgacagagccggcgtataaaccattcctttcggggagcattccccgaaccgtatgtttcgagcacaaccgcctttaaaccttcaatcctcagaatggtggcaattacattttcctgaatgcccggaaagagcttcagtaccactacattggtatccagcaaatagtgcggtttcaattcccgcttttcaccatttccgtgaatttgtacattattatatttaatatggattcccgcttccgccaataccggataattgaaagaacggaatgcattgaagttttctgcattcatctttgtcgtacggtttccccgcatcaggtgattttcaaagaagatgcatacttcgggcaccagtgcccttccttccttgttttgtgcaatggcaatctcgatactggtcatcagattttcctttccgtccgtgcggagtacgccgatgggaagctgtgagcctgtgaggataacaggtttgtccagtccttccagcataaaacttagtgcggaagcggtataagccatcgtgtccgttccgtgcaggatgacgaagccgtggtaacgattgtagttgtcatgaataatgcgtaccagcttccgccacatatccggttccatgtccgacgaatccatcggaggatcaaactgataggtgtcaattggaaaattgaacttttgcagttcggggatatacttttgcagttgctcgaagttaaagttctccagagcacctgtcgcggcattctcaatcataccaattgttccaccggtgtatattaacaatacggaagtatttaatgggttcataagctgattttgtgcgattgttttcgcaaatataataatagatttgataaataagtaacaaaatgtcataaaagtgaaggcgaatgaccggataaagcgcaggcgaaagattctttttatcagaaaaaaaccgaaaaaagtgatagattgaacgtttttattattacttttgcgacacttatcaaaaacaagagtagaaacaaggactatgatgaagtactatccacatacagtcacatccatgtgtaccatgacccttaggggttaatggatagtttttgtgtatctacgtgattcacgcttgtataagcaggcaaaattcaaattcaattttattcgtaaacaaccaatcgttctgtaaaaagcaaactgcaggacattgcatttaaataagtatcttcatgaaagtaatgaaattcggcggaacatccgtaggttccgtgaacagcattttaagcgtaaagagaattgtagagtcggcaaatgagccggtaattgtagttgtttccgcattgggaggcatcactgacaaattgataaatacatcgaagatggcggcagtgggagattcagcctatgagggtgagtttcgcgaaatcgtttaccgtcatgtggagatgattaaggaggtgattcctgccggagaaaagcaagtatcgttgcaacgtcagattggcgagctgctgaacgaattgaaggatatctttcagggaatttacctgattaaagacctttccccgaaaacttcggatacaatcgtcagctatggtgaacgcctttcatcgatcatcgtcaccgcactgattgagggagcaaaatggttcgattcgcgcacttttatcaagacggaaagaaagcatagcaagcacacgctggatacagaattgactaataaactggtgaaagaggctttccagtctattcctaaagtagcgctggtgccgggattcatctcttcggataaaacgacaggggatgtaacaaacctcggacgcggtggctcggactatacggctgccattattgctgcggcgctggatgcggcaagtctggaaatctggacggacgtagacggatttatgacggctgatccgcgtgtcatttcgactgcttatacgattacggaattgagttacgtagaagcgaccgaactttgtaacttcggcgcaaaggtggtttatccgccgactatctatcccgtatgtcacaagaatattcctattataataaagaatacattcaacccggatggagtgggaacggttatcaaacaagaagtttccaacccgcagagcaaggctatcaaggggatttcctccatcaacgacacaagtctgattactgttcagggtcttggtatggtaggtgtgatcggtgtaaactaccgcatttttaaagcattggcaaagaatggaatcagcgtgttcctcgtctcacaggcttcatcggaaaacagtacttctatcggtgtgcgtaatgccgatgccgacctggcttgtgaagtgctgaacgaggaatttgcgaaagagatagagatgggcgagatttctccgattctggcagaaagaaatctggcaacagtggctatcgtaggtgagaatatgaaacatacaccgggtatcgcaggtaaacttttcggtacactgggacgtaatggtatcaacgttatcgcttgcgcacagggagcttcggaaactaatatctcttttgttgtcgattccaaatccttgcgtaaatcattgaacgtaatccacgactctttcttcctctccgaatatcaggtattgaacctctttatctgtggtgtcggtacggtagggggtagtctggtagaacagattcgttgccagcaacaaaagctgatgatggaaaacggactgaaactccatgtagtaggcatcattgatgcagccaaggcaatgttcagccgtgaaggtttcgacctcgccaacttccgtgaagaactgttggaaaagggtaaggacagcagcttgcaaaccatccgcgacgagattatcggaatgaatatctttaattctgtatttgtagactgtacggccagcgctgacatcgcatcgctttacaaagatttcctgcaacacaatatctctgtggtagcagccaataagattgcggcttcttccgcttatgaaaactatcgtgaactgaaaacgattgcccgccaacggggtgtgaagtatctgttcgaaacaaacgtaggtgcaggtcttccgatcatcaatacaattaatgacctgattcatagcggtgacaagattctgaagattgaagcggtgctttccggtacactgaactatatatttaataaaatcagcgccgatattcctttcagccgtaccatcaaaatggcacaggaagaacgctactctgaaccggacccacgtattgacttgagtggaaaagatgtgatccgtaaactggtgattctggcacgtgaagccggataccgtctggaacaggaagatgttgaaaagaacctctttgttccgaatgacttcttcgaaggttctctggaagatttctggaaacgtgttccaagtctcgacgcagactttgaagcccgtcgccaggtattggaaaaagaaaacaagcactggcgtttcgtcgccaaactggagaatggaaaagcctccgtcggcctgcaggaagtaggagccaaccatccgttctacggcttggaaggcagcaacaatattatcctgctcactacggaacgctataaagaatatccgatgatgattcaaggatacggtgccggtgccggcgtaacggctgccggagtatttgccgacatcatgagcatcgcaaatgtttaaacgccttatgaaacatattatcatattgggagacggaatggccgattggccagtgaagtcattaggggacaagacgctcctgcaatatgcaaagacgccttatatggataagctagctcgcatgggacgtaacggccgcctgattactgtggcggaaggtttccatccgggtagtgaagttgccaatatgtccgtgttgggatataatttgccaaaggtatatgaaggtcgcggaccgctggaagctgccagtattggtgtggatctgaaaccgggcgagatggcaatgcgctgtaatttgatttgtgtggaaggagatattctgaagaatcactcctccggacatatatctacggaagaagcagatgtattgattcaatatttgcaagaaaaactgggcaatgaccgcgtacgctttcatacaggagttcagtaccgccatctattggttatcaagggaggtaataaagaactggattgtacacctccgcatgatgtacctttgaaacctttccgtccattgatggtgaaaccattggttccggaagcgcaagaaacggcagatctgattaacgacctgattctgaaatcacaggaattgctgaaagatcatccattgaatctgaaacgtatggcagaaggtaaagatcctgcgaacagtatttggccctggagtcccggttaccgtccgcagatgcctactttctccgagactttcccacaggtaaagaaaggagcagtcatctcggctgtcgatctgataaacggaatcggttattatgctgatttacgtcgcatcgcagtagagggagcgaccggactttataatacgaactatgaaaacaaagtgaccgctgccttggaagcattgaagacggatgattttgtttatctgcatatcgaagccagtgatgaggccggacacgaaggagacatcgacttgaaacttctcactatcgagaatcttgataaacgtgccgtaggtcctatttatgaagcagtgaaagattgggacgaaccggtagccattgctgtattgcccgatcatcctactccctgtgagcttcggactcatacatctgatcccattccgtttcttatctggtatccgggtatcgagtcggacgaagtgcagacgtatgatgaaatagccgcttgcaacggtagttacggacttctgaaagaagacgagtttataaaagaattcatgaaataagtcaccacagattatgaaatattatagtacgaataaacaagcacctgttgcctcactgcaagaagcggtggtaaaagggcttgctgccgacaaagggctgtttatgcctatgtctatcaaacctcttccacaggacttttacgatacgattgatagtttatcctttcaggaaattgcttatcgcgtagccgatgctttcttcggtgaggatattcctgccgatacgctgaaacagattgtatatgatacattaagtttcgatgtacctttggttaaggtggcagataacatctattcacttgaacttttccacggaccgacgttagcatttaaagatgtaggcggtcgtttcatggcgcgccttttgggatacttcattaaaaaagaaggacaaaagaatgtcaatgtattggtagctacttccggtgatacgggaagtgctgttgccaacggctttctgggtgtggaaggtattcatgtgtatgtgctttatccgaaaggaaaagtgagcgaaatacaggagaagcaattcactacgctcggacagaatattactgcgcttgaagtggacggaacatttgatgattgtcaggcattggtgaaatctgctttcatggataaagaattgaatgaacacctttcgttgacttctgccaactccatcaatgtagcccgtttcttgccgcaggcattctattatttctatgcttatgcacaattgaaacgtgccggaaaagctgataatgctgtaatctgtgtacctagtggaaacttcggaaatatcaccgccggattgtttggcaagaagatgggtttacccgtgaagcgtttcattgctgctaataaccgcaacgatattttctatcaatatctgcagacaggtaaatataattcccgtccgtctatcgcaacgattgctaatgctatggacgtaggcgatccgagtaactttgcccgcgtactcgatttatatagtggttcacatgctgatatctctgccgagatttcaggaacaacttataccgatgagcaaatccgcgaaacggtgaaggaaacctggaaagaacatcattatctccttgatcctcatggtgcttgtggatatcgtgcgttggtagaaggcttgaaagagggagaaacaggtgtattccttgaaacggctcatcctgccaagttcctcgaaacagtggaaagcattattggagaagcggtagaaatccctgccaaattgcaggaatttatgaaaggcgagaaaaaaagccttcaaatgacaaaagactttgcggacttcaagaagtatttgttgacgctttaatcctcttcttcctatgaatgaatttgtgccaccttgttggcacggttgtgccatcgaagtgtcacggtcgtgccaacaaggtggcacaattgtgacaatagggtggcataaaccggataattgcaatatagtttatatagaagctaagaatactaaatattctcccgtacaatgaacagtaaactcatttgctgttgcttcattaagcgttccttgccaccaattagtaaaatcactaagaggataaactaatccctctccttgcaatcctttcgctccgaaattgaaaatagaaacttgttgccccggatgagaggcgaaggtttgcgtgtctttggcggggataaacataccataatcggtaatggtacgtacctcgataccatctttcatgtagtcgatcagcagactgatgtttcctaacgtatgatcttcccgtttgccggtggctccgacgatggcaattctccggaatcctttcttttgcaggaaatgaacggctttggtttggtcgttcgtttcttgatccgctatctgatgtacaataggggagaaaagttctttatattccggggaaagagaatccccgtcaccgataattacatcgggggtatgcccacgcaggatatattcattggcagccccgtcacagcaaactacaaattctgcattttccagcatttgcaggggaagaggatggctgggatattcgccattggcaagtatcacggcttcgggagtatagtgttcgtatttcattgtatgctcattaattttttccacttaaagtagccaaagatagctataatggagtaaagtccgtataaagcggaagtaaaataaaggtctttgtagatataaagtccgcagcagacaatatccacaaaaatccaggcaaaccattgctcgacgtatttgcgtgccagcatccacataccgacaatgctcaatgcggtagtaaagctatctagccagggaacattgctatccgtatatgctatcagtatccatgcaataccgaggaaagaaacgacgaataccagaaaaagaggcaagtaacattttcccggagtatgtacgataggaagatctttaggggtgtcaccggttgaagcatctgctgtcgtcagttgacctttctttttcctgtgtccccacatccagaagaaccagccgtagatggcagctatcaggtagtagatattgatgccaaagtcagcatacaatccggctttgtaatatacgaagatgtagatggcaggcatcacaatacccgctatccaaaggtagatacttgcccggtactctaaccaaaggtagactagcccgacaatcgtaccgaatatttccagaaaattcaattccataactctgtgtgattaaaagcggaaagaaacatgtcccataacgtttgttcctgcttgagctgcatatccggcatagtttctccgattttccagcgtatcggtgtagtcacttgatgcccagccgttgttttcatatttttcattaaacagattgtatacagtaaatcctatggtgacttctttcagtactttcttgggacggaagctgtacgccagattgaggttgctgacaaaatacttatcaagagtcagttcttcaacttctgcgtttgtcatatactgtttgctcacgaactgtgattgcagggcagcttcgaatcccttataattgaatgagaaacgattgttgagtaagaagtccggtgagaaagcaatgtgagtgtctttatgctttatctgaatagtcgggagagaagtagagctaccgtcgtcattatagtggtagcccggcaggctctctacgaaatcctgaatacggtttttgctccatgtagcgttgatatcccattgaaaccatttgcacggtttgattcccagcatgatttcgattcccatgcgataactgtccggcacgttttcggtcagtgcttcacctatatcgtttaaggctccggtcagaaccagttggtcggtatagtccatgtagtagaagtttgcacctgctgtcagccattggttggcaaaggtatatcccgcttcatagtcgagcagcttttctgctttggggtacgagtccggatcgccatccgtataattgtttcttgttggctctttttgagcaaccgagaaagaggcatagacacgatggttggaagtgatgttccagtttaatcctactttcggattaaagaaatcgaactttttatctactgccagtggacgcagcgcatttttactccagtcatatttatcattgtttccgtcgatggtatagttgatgtggcgatactggagatcggcataagcacttagtcctctagtaagatcgtagttcgctttcagataaatatttccatcggtcttcttggatttgttgcggtaatattcatggtcgggagatagagaacctacgtagtttttcacccagggaactcttccgaagttattgccccggtattgattcaaaccacctcccagagacgcatttagcctgttagccatgtaattgagagaaaaaacgccgccgccgaatttgttgtccatcttcttttgacggactaaatcgcttttagatacttcggttccatctattgtaaatgattttaaaccatattctatcaggtatctgccgtctttgtactcttcgtaataaccgtcacctttggtataatgtaaggcaacgttcagattccaggctgtcgagaaagtatgattgaagagaagctgataattcttttgcagataattatctgtttggtcgtcgtaataatattttttgccgttggcatcagtgtacatttccccgcaaggattgtagcgtctgccgaatttttccatttgctcttttgttgcgtatccccaagcatgatatgttttttcttttccggcaaatgcaatgagcttcacagatgtgttttctgcaaaataacctccttgcaggtagtaagagttcaagtccaccgaagcacggtctatgtatccgtccgtaccgatattggaaaggcgggcgtcaaacgtccagtggttattgagtaggccggttcccactttcactgtttccttgtgcgtgttgaacgaaccgtatgaaccattgaattcggcgtatggtttcatagatgcaccttcggtttgcatattgacactggctccgaaagcacctgctccgttcgtcgatgtacctgctccgcgctgcacctgcatatcttttacggaagaagaaaagtcgggcatattcacccagaacaggttatggctttcggcatcgttcatcggtatgccgtttaccgtgatgttgattcgtgtgccatcggttccacgtacgcgaagtgtcgtatagccgataccagctcctgcatccgatgtggtcagtgtggaaggagtcatacttagcagataggggatatcctgtccgaagtttacctttttgagttctgctttgcctatattggtgaatgccacgggagttttggctgtggcacgtgtggacactacctgcacctcttgcaggtttactactctcatactatcctttgcactcgtctgtgcatgaacagtgatacctgcgcccaataaggcgacggccatccatacaattcttttcatttttgcttactaattagttctctacgccggcattacccggatcagattctatgggtatgttctcagcccgtcatgttaaggcacccctaccagtgaatcggtgacaaaaatactgcttttgcaggaggaaagcaaaaaaaacttttagattcactaaaaacaatataactttgtaaattgttgaaataacaaaactgcatttattcacttaatatatatttaattatgctactattattgcaagcaacacaagctgcggactctgtgcaagtggctgcagacgaattaatgaaagaggcgattgccaatgctgacggattggataagctttcgctgattactcaacaattgatagacttcggtattcgtgccggagaacgtatattgattgcggtccttgtctttgtcgtcggacgtttcctcatctcgctgctcaacaaattcatcaggcgtctgatggataaacgaaaagtagatgtaagtatcaaaactttcgttagaagtctggtcaatattctgttgacaatcctgttaatcatttctgttgtcggtgccttgggagttgagacaacttcatttgcggctttattggcttccgccggtgtcgctgtcggtatggctttatccggtaatctgcaaaactttgccggtggactggttattcttttgttcaaaccttataaagttggcgattggatagaaacacagcagggatcagccggtacagtaaaagaaattcagatattccataccatccttactactggggataataaactgatttatataccgaatggttcattaagtagtggagtagtgattaattacagtcaccaggaaacccgccgtgtagaatggattattggtatagattatggggaagattacaataaggttcagcagatagttcgtgatattctggctgaagataaacgtatcttgaatgaacctgctccgtttatagctcttcatgcgctagatgccagcagtgtgaatgtggtggtacgtgtatgggtaaatagcggagattattggggtgtttatttcgataccaataaagctatttacgaaaccttcaatgaaaaaggtatcaacttccctttcccacagcttactgtgcatcagggaaattgattgttatactctgataattcaaaaaataagggagttgtacttaacgtgcaactcccttattttttggaaaacttgtctggtgtgattgaataaatctcttttttattttataccgaaatcttcggctagttcatatctatcttctttgattcccagtacatgattaatttttctccttttctcgagatctttaaagtagttttccacaacctgatagagatcgaagttagtggttgatcctgcggctaaatcgagtgattccaccatcttttctacggcttgatggattttctctgcgtctatcagatgcagttcgttgctgtgtattaaatatttttccatgactgcaatgtttttaatgttatataggtataacatcttgcagtcatggaaagttcaatgattgaatgttagattttggcaagcgcctgatccaaatccgcaatcaggtcatcaatatgttccgttccaattgataaacgtacggtgcccggataaatctcctgttcggcgagttcctgtgcattgagctgtgaatgggtagtgcttgccgggtggatcaccaatgatttcacatcggcaacattggcaagcagggagaaaatctccaggctgtcgatgaagcggtgtgcttcctcttgtccgccttttacctcgaaagtaaaaatggaaccggcaccattcgggaagtaacgttgatacagtgcatggtcaggatgattggataatgacggatggttcactttcttcactttcggatgattgtttaagaaattcactaccttcaatgcattttctacatggcgttctacgcgcaaggaaagagtttccaagccttgcaacaggataaaagcgttgaatggactgatggtggcacctgtgtcgcgcagcagaatagcccggatacggatggcataggcagccggaccggctgcatcaacgaagcgtacgccatgatagcatggatcaggttcggttagttgtggaaatttgccggaagctacccagtcgaatttgcccgaatctacaatgactcctcctaatgacgaaccgtgtccgccaatgaattttgttgcggaatgtactacgatatctgctccgtgttcgatagggcggattaaatacggggtaccaaatgtgttgtcaataatcaaaggtattttgtggcggtgggctatttcagctactgcctctatatcaatgatatttgagttcggatttcccaatgtctcgataaatacggctttcgtattttcctgaatggctttttcaaagttcgataaatcacttggatcaacgaatgttgttgtgatgccataactgggtaaggtatgagccagtaagttatagcttcctccataaatagttttggctgccacaatatggtcgcctgcacgagtgatgttctcgaaagcataagtgatagcagcggcacccgaagcaactgccagccctgctactcctccttcaagagcggctacgcgttgttcaaaaactccttgagtggagttggtcagacgaccgtagatgtttcccgggtcctgcaggccgaaacgtgcggctgcgtgagcggagttgtgaaatacataagaagtagtctgataaataggtactgcacgggcatctgttgccggatctgcttgttcttgtcctacatgaacttgtaaagtctcgaaatgtaaattctttgttgccataatcgtatattttttaagtttaatattctttctttattttcttgcaaagttattggatgaagatatatcgaacaatatatatctaaaatatagaaaataatgctatttttgtgccattatatggaataatataactgtgctattcctagaaatcaccttttagaagaatatttttcttatggatacttttgataaactggatagagtcgatttgcaaatactccgtactttgcaagaaaacgcccgattgacgacaaaagagttggctgcacgggtgagcctttcttcaactcctgtttttgaacgtcttaaacggttggagagtggaggatatataaagaagtatattgccgtattggatgcggaaaagctgaatcagggatttgtcgtattctgcagtgtgaagcttagacgtctgaacagggatatagcagccgagtttacacggattatacaggatattcctgaagtaaccgaatgttataacatatcaggaagttatgattacctgttgaagattcatgctcccaatatgaaatactatcaggagtttattttgaatgtgttggggacgattgatagcttaggatcactggaaagcacgtttgtaatggctgaagtgaagcatcaatatgggatacatatttagttcgttgtgtgatagtctgaaatttatcttgtatatttgctatgtaatataaatcctcttctgctgacacaatgaattcaaaaacatatcctcgcaccaatgatttccagactgtttatctgaatacagtgattaagaatcctgccattatggtaggtgattatacaatatacaatgactttgtaaatgatcctgttctttttgagaagaacaatgtattatatcattatccgattaataaagaccgattgataattggcaaattctgttccattgcttgtggagccaaatttctttttaacagcgcaaaccacacattgggttctttatccaattatacgtttcctatcttttttgaggaatggaatttagataaaggagatgtaacttctgcttgggataataaaggggatatagtaataggtaatgatgtctggattggatatgaagctgttatcatggcaggagttcatatcggagatggagcggttattgcgtcgcgggcagtggttactaaagatgttcctccttatacgatagtaggtgggacaccagctaaagaaattcggaagcgttttgatgagaatacgattgttcaattgcagaaattgcaatggtgggattggagtattgagaagatatccgaatgtataccttatattataggtggaaagattgaaaaactgaaaaagataaatatcacatcatagacatgaagaaactaattattgtatttgttcttttattatcagcactctcttgtttctcacaaatagagttttcgacttgcctttttgatgcttcaagaaacagagtgataccgctagccgtctatcagccgcacaaagtgaattcgaaaacaaaagtcattatatttagccacggctacgatggaaataaaaataataagtccaatcagacttatgcctatctaacacgattcctttcccagaaaggcttttacgtaataagcatacaacatgaattggcagatgatcctcttttggccatggaaggtaatttcatggaaacacgcatgccaaattgggaaaggggagtggcaaatattctttttactattcaggaatttaagaaattgaagccacaattaaattggaatgactttatattgataggacattccaatggcggagatatgaccatgttatttgctacccgatatccgcagttgataaataaagccatatctatggatcatcgcagaatgataatgcctagaacacggaatcctcgactttatacgttaagaggatgcgattatgatgcggattcaggagtattacccactgaaaaggagcaggaacaattccggatgaaggttgtgaaattggacggaataacgcatagtaatatgggggagaatggaacggaagaacaacacaaccttatcaatcagtatatctatggatttcttacacggagataactgatgtattatatttattttatccaatggttttaaatcggaagcctgtttttcttataactttgcaactgattttagaaaaagaagtttgggatgataaataaatatgaagaacgactggggacagagcgcatgttaccgcttgtttttaagatggcacttccggctgtggcagcgcaatttgttaatttgctttatagcatggtcgaccgtatttatattggtcatatccctgggattggtacggatgcattggcgggtgtaggagtaacgacttctcttgttatactgatttcttctttttcagcgatagtaggaggtggcggtgcgccgttagcggctatcgcactcggacagggggatcgttcacgtgccggaaaaattctgggtaatggttttatcctgctgatactattcaccttgtttacttctctcatcgcatatacctttatggagccgattctactctttacaggagcttcagaaaatacattggagtatgcagtcaactatctttctatctatttattaggaactatcttcgtagaaatatccacaggattaaattcttttatcaatgcacaagggcgtcctgctatcgccatgtactcggtattaataggagcactgttgaatatcgtcctcgacccgattttcattttttggctcgatatgggagtaaaaggtgcagctctggctacagtgctttcacaggcatgtagtgcagtgtgggttttaactttccttttctcccggcacgcctctctccctttagaaaaacgttatatggcgttgaaccgggaaataatactttctatatttgctttgggcgtatcaccgtttattatggcaagtaccgaaagcctggtcggctttgttctgaacagcagcctgaaagattttggagatatttatgtcagcgcattgaccatcttgcaaagtgcgatgcaatttgcaagtgtcccattaacaggatttgcgcaagggttcgttcctattgtgagttataattatgggcacggcgacaaacaacgtgtcaaagactgtttccgtgtcgcattgataaccatgttctcattcaacttactgctgatgttgtttatgattcttttcccctcaacagtagcttccgcctttacgagtgatgaaagattgatagaaacagtccgctgggcaatgcctgttttcttgggtggtatgactattttcggattgcaacgagcctgccaaaatatgtttgtagccttgggacaagcaaaaatttctattttcatagccttgttgcgcaaagcaatcctattgatcccattggcattaatattgccacattttatgggagtagccggtgtatatgcggctgaagcaatatccgatgcgacagcagcaatttgttgtactttgttgttcttctggcagttccccaaaatattgggaaaaatccaaaggagcactttgcacataagctaaatttcctgatgtttatccataaatagaactaattatgtaacggcttacgtatttttgcgaaaaatgtttgttcatattataaaaagctaatatatttgcgtaatcaattacgtatttagtgacgcaactaataaaaacatggacttttttaatcagacaggcaaattagccatcggtagcagattacgcatgttgaccgataaaataacagtagatgcagccgccatctataaaatgtttggagtagacctcaaaccgaaatggtttcctgtattttttgtattatcacgtggggaggcaaaaaccattacgtccatagccaaagagattggtcattctcatccttccgtgagtaatattattaaagaaatggtagctaaaggattagtgaaggagacaaaggacaaatccgacgggagaagaaacatggtcatgttatctgccaaaggaaaaagaatgtccgactctttttcggaacagtgtatagatgttacggcagctattgagcaaatcacgcagcaaacccggaatgacctttgggaggctatcgaagaatgggagaatcttttgttggataaatccctgttggagcgggtgaaggaagcgaaaaaggaacgagagagtaaggacatcaaaatagttccttatgaaccttgctatcaatctgccttccggacccttaacgaagagtggataactgcttattttcggatggaagaggccgattacaaggctttggatcatccaaaggaatatattctggataagggaggagctattttggtggctctttataaagatgagccggtcggtgtatgtgctttgtgtaagatggatcatccgctttatgattatgagttggccaaactggctgtcagccctaaggttcagggcaaaggtattggagtactgctttgcgaagcagttgtaaataaagcgaaggagcttggtggtaaaagaatctttatagagagcaatacgcgtctgaaaccggctatccatatttatcataagttgggcttcaaggaacttcccgaatatcacacgacttatgaaagaggagacatacagatggaattaatgattgaagagtgaaaatgaaaaaggtggatggtgaatttattaaggggcgcattgccccttcattccagttcctgcgcataaatgttgatagcgcgtaatgcctttgatatttcagtcggggtgattccctgacattctattctcaacactttttcccagtcctccatatctacattccatttgtagatttggggacatagggtgaacagcgctgcgatatgttttatatcccgtgcatttctaaccgaggttcgaaaaatgagtatttgctcttccatagttactatcaattacttttgttttcagtgcaaaggtaggtttaaacaaggttctgtataggattattcgacgaatgccctgattactcatgacgaaataagtaatcggggagattaacttcatatacttatcctttgaaaagtcagtcatctgtacctgttaatatataaaaaagtgtatctgttctcgtctttcttttttgatttactttgcagtgttgttttaatctcctaatatacttaaaggttatgaagttgaattttgctaaaagaatgtcttatataaaggcttcggaaataagagagatattaaaagtcaccgaacaggaagatgtgatttcgtttgcaggtggtctgcctgctccagaactttttccgatagatgaaatcaatgagatcaatcagatcgtattgaaagaggcaggtacgaaagcgctccaatatactacaacagaaggttatgctcctttgcgcgaatggattgccaaccggatgaacgaacgtttgggcacggctttcgataaagataatattctgattacccacggctcacaacagggattggacttatccggaaaagtttttctggaccagggagatatcgtactttgcgaaagcccaacatatttggctgcaatcagcgcgttcaaagcgtatggatgtagctttattgaaattcccacggatgaggacggtatgatgatggatgttttggaagaaattttgagcaatactcctcatataaagctgatatatgcaatacctacttttcagaatcctaccggaaagacgtggagcctggaaagacgcaggaaactggctgaattatccgcaaagtatggtgttgcagttattgaagacaatccgtacggcgagttaaggtttgaaggagagtctttgccatctataaagtcttttgatgaggctggaaatatcctgtgtacaggtagtttctctaaaatattctgtcccggtttccggattggctggattgcgggggataaagagattatccgcaaatacgtattggtcaagcaaggtacggatttacaatgcaacacgattgcccaaatgaccatcgccgaatacctgaagcgctatgatattgataaacatattgccaaaatagtagaagtatacagaaaacgcagaaatgtggcgattgaaagtatagaacgttatttccctgatactataaagtttactcgtcccgaaggcggattatttacatggatagaacttcccgaagggatttcggcacgtgatgttttagtcagaagcctggagaaaaagattgcttttgttccgggaggctccttttatccgaacggaaacaaggaaaatacgcttcggatcaactactctaatatgcccgaagacaaaatagagaaaggacttaaaaccctcggcgaagtggtaaaggagtatatcagtcaatcaaaatgattctttgataatgtttcccaaaacctgcaagcgttcttcaatgaaagcactccattgctgaccgaaactcaagcgcatacagtttctgtactggtcgtgcagagtaaacatgcgtccgggagcaatgctgatcttatgttgcatcgctttgtaatatagctccgtggtatcaatctttttattcagttccacccaaagcataaaacctccttgtggagtgatgattttagtgtcttcgggaaaatagtcggtaatagcttgtgccaaatgaagactattggaatgtagctcatggcgcaacttgcgtaaatgattctcatacctgccgttctccatgaagttggcaatggcttcttggttgagggtaggagtggatattaaatgaatatgtttctgacgaataatagcatccttaaacttaccgggggcaatccagcctacccggtaaccgggagctaacgtctttgatacagaaccacaccataacacaagtcccttttcatcgaaagctttgcatggcttagggcgtgaatgtccgaagaatacatcgccgtataaatcatcttcaatcagaggaatattgtgttccgccaacatctgtactatctctttcttatgttcatcgggcatgcaactcccaagcggattactgaaattactgataagcaggcatagattgatctgcggcaatacttttcttaaagcatcgggttcgatgcctgttacaggattggtcggcagttccagcacatgaagctccatactgttggccaactgtaatatcccgaaataaacaggactttcaacagctatcgtgtctcctctttgagcaataacagataatgctaaagagatggaattggttactcctgtggtagtaacaatatcatcttcggtcagatttccattccagctatacgcaaaacgggcaatatagtttctcaaacgaatgtttccttgagggtcttcatacctggtgccgtttcccggaagtgaatacatggccttggccagttctttattgagtttggcaataggcaataaaacatcttccggtattcccagcgaaaaacgggtgatagacgaatcttcgatggaatgatatacttccatgattaagtctgtttcttcctttcccggagattgggcggaaggctgtgttgttgccggcgcagacaaatttagtggcttataattgacaatgtaccctgatttggggcgggaaatgatgaatccttccttttccaattcataatatacttgaatggctgtgtttaaacttacgccatattcattgctgatagtacgtaaagaaggtaatttctcgcctgctttccatatacctgtttttatttgccaggcgatagtgccggctatcttttgatataggatttctcttttcatgtttattctgtacttggcaaagatacaaaaatgatgtctgtatctgttgttgtttgattgcaaataattcattcagtcattttttataattgcttgctattcagttataaatttattccatatcattatattttagacatgacaagattatcattgaaatatatttcaacatatacattcctacgatagaagcgtcaaaaataaaagagacgaacaattttcttaatttaagtttaggacttcaacagtcgattcgtttctcggtgagaaacacttcgtttctcggtgtcgaaaaggttgtttctcggtgagaaacgggtcattggttttaaaggaaaagcccgaatagtaaccgcctggataacagtgttttacaaaataacgttatctatcagaaatacataggagttttattgacatttttttggcaacaccgtttatttctattgcatctactactgtaataatatttacattagaactaaaatatggcatttataaaagaatctgtttcattcctttccgtaccgttttgaatcaaataacaataattggagcttgggaagaatctacatgatgaagtagatgaaatcaacatttataatagtggcatttctattctcgtcacctgttcttcttcgggtacgttgggattgctgtaataatattcgatggatgttcccgaaggtttgtaaccgttgttttttatccattccatcatctcgttgtacagggcagccagttccttgtaagttcctctatgtaggcaggaaactatttttttttctggtatcgttatagaccgtatatccccttcaccttgtaactctctggttgactttagaccaataatcattctgatattttgttccgtcagactttcaaagttgggatattcaacgtaggggatgtcggtagtgacttcaccctgttccttaaataaagagtctatttttacaaaattcttcccgatagcttccgacattccgttcatatctgtttgtacttcaacagccaaagcggattgttccggttgcttcaatagcatgatttctgaaatttttcccataatacattgtttttagagggttgataattaattatttcttgatgaccggaatatagatgtcggtaattagttctgttctaagggtggaggcagggcggttcatatacatttcaaagctaaaggtgctttgaggacgatatttactttccgggaaccactcttcataaatagtccggtagaatttatgcaataaagagtagtcaccgatatgcctgaatatagcataacgaccaccgggaacttctatcactcccggctggaaatcattttctttgttatcgattatgaccccgagatagaagcgacatttatctattggggtgatggccgggtcgtccatactaaggctgacaaacttatcattcgacttttcttcattgcgctgtctagcatagttggtgagcctgtcccatattaatttgtatcggagttcatccttatacttttcacccacctcgatacaaaatactttcatcggcagaatcgaccggatttcaggagtgataaccgcatgctgttcgtcatacatcggcttatatttctccctgtattgagaggttgacactccaaaatgttttttgaaagcttttgccagactaaatttagtctgatagtttgtctgctccgcaatctgatttaatgtaaagtcggtggatactaacagatgtgctatatgttcgaggcgcaaacgttgtatgtagcttccgatattttctccggcaacggtttgaaacactcttctgaagtgatatttggaaagtccgcttatcgtactaagtatatctgcatctaaactatcgaataaatgattgttgatgtaaacgactatatcctgaatcttttggtgatggatattactggtttccaacttctgtttccatcggttcagtttggggagccgttcgttgagtattcgcctaagttcctccggcgaataagcggtatctgcatattcattgtacttatcagtgtattttatccagatattaatcatttccgacatcggaatgtcgacgatatattttccgtctttcagacagtagtagcaatattcgtcacttcgggaaccgttggagttagtacccagatatttctctatatcaaagcggagaggcatcccgcaactttgacaataccttttatttatatctgattcaatcatcggttgggttttcgtttgatggatagcagtcgctccatatcattaaataaataagtgtctttcaattcgaacataagccacttcccatcgtggaaagtagtcgtctcattgtatatcttttgagtctcattggaaaagacctcccgcagagattcaaatttggcacactcatctttacctaaaatgaccaagaagccaatcgtttgttctttggcgtatagggcacacagcgtttttccgcctttgcgatatttatattcgtatgtccatttttttcctccatggttccatagttgttccatattgtacttttgctcgataagctggcaaagtgaagtccatatatcataaagttccttacctatcaaggcttccagtgcttcgggagtgggaatctgcaaagtttctttcatggtattctgtatttacttttgattatccatatcacaaaggtaggctgattttctaatagatcgttgtccaatataggcattttgtgtgtagctggtgaacaatctgcccggaaattaatttattttgtaaaagcgaaatattggcagtataacctttatctttgcattaatttaaaaacaaggccccaattaaagaaaatgaaaacaatattattagcagtaggtacgctctgcctcatggcaggttgctcgtcaaaagtggcaagctcaaaaggaatcgttagtgatgcaaccatgaatacggtaacgattgttactgataagaatgataccctttcgttcagtacgatggatgcaaataaagatgaagtcaacggtttgcttctgaatgatacgctggaagtgttctataccggaatatatacaccgggaatgccggcttctaaattagttcagtatccgcaatctccgattgtgggaggtgatcgggatgaacatggctgtatcggttctgccggatatgtatggtgtgaagtgcaaaaagactgtatccgcttgtttgagaaaggaatccgcacggaatcggtggacgatagtaatgcttctgcctttattgtgtttagtcctgactctacgcaactggaacttttcttttccaataatcagcccaatgaaatattggagagacgtggcctgccttcaggaggttatgcatggaacgtggaagatgacgatacgaaaaatgtacggctaatagatggtttgtggacaatcagccaaagaaataagttaatttatagccaaaaggccggaaactgattttaaaagctccggctttctgacgctctgtttgtagagtaatgttctaggtaattaaattaataagtggatatcaaagatgctgaatatataaacttccatcataatctttgtatttagcatctttgtatatatcaaccagtttgttactgtaatcaagaatggtatctttggagatttgtgatacatttgtagccaaaataccacttcccaaaatgcccggattacataatatattgtcttttcttattgaattcatggtaagctctacacctatgtaatccttgatacctgccttttccagactggatacaatatagttgtccaaagattctttatcatctccggtcatgaatccataccataataaacacttcatacttaattgagtagcctgtatcaggatatcgagataggttactcctgaatctcctttcttgtctatttcgtaaggatcgatatggatgaaagaggatgcgggaagtgaaggcaacagttctattgtgcctttcagggagtcggtatgatgtatttctacggatgtacttaatccgatttgtttggcataaatgtctacattctccagcgcactcttttctaaatcgaagaatacgaacctttttgcttgctttcctaatacattcattgccagggcaggagaacccagataatttccttttgccatttctgtactttccagttggtaataaatggaatcttttagagatttgtcatcatctgctttctccaggaaatgatagataccatattgctgctccggggtttgtgtcatggagtagatggcacatgcggaattggtttctacatatacttgtggggcttcatttctaagaacttcacagagtatcagatgtttcagtacatcgggttgttttgcgaaatgagtgtaagttgccatgtgggtacatcttaatatttatagaacataaaagaactgcaaccgctatcctttttaggcattcattaattcatggatttcatgaatatgcaggtgtaaatgacttagataaccttctatcatgtcttgtagcgtaacctttgttccttcaaaatcacaccagtagctattcagttttgtctggtctacagattttataacctgaatgatatgcaggttaaaaaacttccatagttgaatcaggttattccaatcttcattttggtaatcttgtaatgctatccacagatcattatcctgacggtaatcgggaaagaaaagcaaatctttactgtattgcaatctgaccatgcgttggtgattgtttgatgccgaatcaatcaaatgtccgagaatctgtttgatggtacgattttgtttattacgtttcaacgtgatcgtatcattttgtagcccggttagtattttctcttcagtttctatcacatgatagattccttctgttattttggaaaaatcgacgtttgacataccattcttttcctttaggtgtttatagcaaaattgctaatggtacaaatatagataaatgtgtcgatatttataaattaaacggaacttttcaattctaattttatccctctttcttaaaccacctgtaaaaccatttaccgaccttttcgtaatgtcgggtttcggtatcagtatatagcttagagaagaaagacgtatccaatggctctcccgactgattgggatacagcacgataaagctattgttggagaaatatttcccgagctgtctcggtaacttctcaaaagaactgtcatacgaaagagttcctggtcgtgcactgataataaccaataaatgatcgtaacttacctgtcctgtcaataccagcaggtcattccagtcttctaagagagagaaatcggtaagcgtctgtttatgccttttctttatccacgcttgtaggcggatggtagtcttttcattggcaaagaagtgtacgcggcatccaagagtgctccccatgcgacagaagtgctccatccaatgcggaaaaccggattcatattcggctttaggagggacggcaacgacaatccgtttgattgtatggaccggtatcagaaatttagagataattatttcacagtttaatccgttcaataagtgttcggcaagtattccaaagtatgaatctgtgatgtttttcttgcggtgcaggccggtgataatactcgtaatctcattctccttgactgaatggataataccggaagctatattcaaatcataccgggtgacctttttgagtggtacatttgcttccgttgctgtcatttcagctttttcgagataatgtttgcttcgaattcgtagattatcagagttgttatcgtcgttgatgacatttaatgccaggagattatctttcaatttggggtcacgtatgactagagaaagattcaccatgtcctcgatagtgtccgggttggctatggatattaaaatcttctctgtttctttcgacgattcattttcaggttgtgaatcatccatcgccatttttctggctgcccgttcggtaatcagtgaactcactacgcaagtgaccaggataagcaagactgttccgtttagtacatcatcattcaataaccgttcgccggtgggcagaataatgttgtatccaactaacacagccgccaatgtggctgccgcctgtgcattactcaaaccatacatcagatttcgttcaagaacagacatcttatatatcttttgagtgagccagcaagcaatccatttgcctgtcagcgccatggttatcatcacggcggcaacttttaaggcatccccctctccgaaaataacacgtaagttgattaacattcccactccgataaggaaataaggaataaaaagtgcattaccaacgaactctaaatgatccatcaatggagagacgtgggggatgagccggttaagtaccaatcctgcgaggaaagctcccaagataccttccataccaacaagctccatcaaccctgctcctagaaagaccatcgcaagtacgaaaataaattgcatcacgttgtcattgtaccggtgaaagaaccaacgaccgatgcgcggaaagaaataaatgatcagtgcccctagaaagattacttttaccaccagccaaatccaaaacaatcctccggtttctcctttgaacagtccgcctataacagccagtaccagcagcgtgagtgtatctgttacggccgttcctcctacggcaatacttacgctacgatggcgtgatatgccgaagcgggtgacgatggggtaggccacgagcgtatgggaggcatacatgctggctaataatatagaggtgattacaccatatttcagataagatacattggccacgaatccaatcccgatgggaacgataaaagccagtaaaccgagcactaatgctttgtttcgcgtctctttgaaatctcccatattcatttccagaccagccaggaacatgatgtaatagagtccgactttcccgaataactgaaagctgctgtctcgtaccaggatattaaatccatgttcgccaatagccagtcctgccaagatcatcccgataatatgagggatgcgcagtttattcaataatatcggagcaaacaatataatcaagagtacaaggagaaatatccatgtagggtcggtgatagggaatgttaaatcaaggccaatccaatccataatttgacgagttcgtgatatttgttccgcaaaataacctaaaaaaatgcttctaaaaaagcattagttaataaaattcgtccatttattttttctccagattcatgattgccggaatgaagaatgcaagtgttcctgggacatacgtttttaaatatacgatgattttatccgtgtgtgcgttttggggtgtatagtgattttatccggctctacttttagcaataatagtagtgccggatatgtctatttttcgaatcctaaatcatgttcttgtattcctcttgttttttcttgggtaacttctttataacttcttctaccgagtggctaatcaactcctttatgagtttatcgggaacatctccttccaagtaaacggttatccaatgtttcttatccgaaaaaggtccccaaaaaatgtcttcgtattgttctatgagctcttctgatttatcaggattacatttcatatccgcccagaatcttccgtttttaggacgtaatgtagcaaaagtgaacattttatccataaccttgaaaaccaaagtatgttcatcaaacggcatacattctgttgctcctttgactgacaggcaatattctctataatcttcgatattcatgacttctctcttttgattcattcaaaacacaaatatatcactttctgttcgcttttgaaaaatatgtttctatctcaaagtacccgtttcaatttcgcccttatccggcttaaacttaccggagttattcccagataagaagcaagacattccaatggtgttctctgtaatagctccggattattttgtatcagcttcatataccgttcggacgcggtggtgaataagagagaaataagtctttcctctgtttgcaggaactctgattcggcaaacttgcgcccccagttggcaatatggatatcttccttgaataattcgtgtaagtctttgcgctttaatagatacaacaccgagttttccatcagttccattgactcatacccctgttgattatttacatagcttttcaatgagacaatggttgacccttctttcccaatccagaacgttacctcttttccgtctacgggaatataagctctggcaatccctttctcgatgaaaaagatattcgtttcagtcttgccagcctccaatatatgataacctttgggatatgtgacttttgacagatgtttgaccaccttatccgctgaagcctccggcatccgatatatcctgtttataatctcgtgtatatccatatcgcattgaatcattattctgcaaaaatacaaaaagttatattaggaaaagaagaattgatgatactcttacaccggcgtttcttatcaaatgtaaagtgaaagctccgggcatcttgttaattttgcaatctaatattaaaatagaaggatatgaattggattatattgattattgccggactgtttgaggttggttttaccttttgcctaggcaagattaaaggagcgacaggcaccgatttttatttgtggggagcgggatttgtaatctctgtaatcttaagcatgttcctgctggcaaaggctgcgcaaacattgcctattggcactgcatatcctgtttggacggggataggagcggtgggaaccgtattgaacggtatcctgttctttcatgaaccggcaactttgggtcgtttgttttttatgacgactctgattatttcaatcgtagggttgaaactgatataatcagacgaataggatttagttttaatagatggaaaagtgtaataaggactttttcagtgtaagtcatatattgttgaaaagattccatccggtataatattgaggaagtttggaattgacgaggtcgattatgtaatatatgctttcgtaattctgcgattattaggcatttataagaagtcgttttgatgggaaaaagtttggtttctaaaataaatgtatatatttgcagaatgtgggacgcatctcgtccggattcgaaactaaactaaaattctatttactgttatctattaaacatgaaatccactgattctgaacctcaagggggcggtatggaactggaacagtaccgtaccagcctcgaacagatggttgaagagaaatctaaagacttgatcgctattcaggagaatctcgaagcaaccaaccggcggcaggcattatttatcaaggtactgcaaattctgcaattggaaccggatatacctactgctatgaatatggcactggccgaaattggccgttatactggtgtcgaccgtttggcgacatgggaaaaccacctcgacggagttacgtatggctgcaccaacgaatggtgcaacgacggtatagaacccgctatcgattacttgcggagtatgaccattgaagcgggaaaaccctggttcgacatgctggaagaaaaccatatcatttgtacgtccgatatttattcgcttgatccctttattactcaaatgctcgaagtgcaaggcgtaaaagccattgctgtttttcccctgtcacaattgggagtacatttcggctttctttcgttcaacttttgctggaacaaacaatgggatgaaaaagatgtggaactgatgagccagatatcgcaaattgtatctactgctactaaacgctggcaagttgaaacatcgctgcaacagtcgcagcgaaccatgcaaaaggtattggacaatatcaatgccaatatttttgtgagtgattacgatacgttgaaagtgatttttgccaataagcctttcagggaagaagcaggagaagttccggaaaatgcggaatgttggagaatgttgaatgcaggtctggaaaatgggtgtaaacactgcccgaagccgaagttgctcgatgccaaccgtaagtttacaggcgttcatttttgggaagactacaatccggtcaccaaacgttggtataccatccagagcatggcaataaaatggctcgacggacgttgggcaatcatggaactggctaccgatatcaccacccgcaaacaggtggaactagagctgattcaagctaaagaaaaagcggaagaatcggacaggctcaaatcagcattccttgccaatatgagccatgaaatacgtactcctttgaatgccatcgtcggtttttccagtctgcttgccgaaaccgatgaggcggagctgcgtcatgtatatatgtctttagtgcaggagaacaatgagctgttgctcaaccttatttccgacattctggacatctccaaaatcgaagccggtatgatagatcttgttatgggacgggtggatgtaccacaactttgccgggaagtgattgctaccttctcacacaaaaaacgtgacactgcggtcgaactgcggtttgatgaaaattcaccgcagattgtgattgatgctgataaaaaccgaatcatgcaagtactctctaattttctgactaatgccttgaagtttacgactaaaggctcaatcacactttcctattcattggaagatgagagtcaggtgcgtttttgtgtaacggatacgggcaaagggattcccgatgaacaaaaacatgaaatatttaatcgttttgtaaaattagactcatttgtacaaggtgccggattgggattatccatctgtcaaagcctggtcaataggatgggcggaaagattggagtcgaatcccgtgagggggaagggtcgtgcttctggttcactcatccgtatgttcccggtgcttaaccaaaaaaaagagattgcatattgaagcaaactacgtatattgttccgcaaagtacgggacgaacaaaaaacaatagttttcttgagagaggtgtctgcaaactaaaataacccatattttgttgtctttatacagtattgagtttttagcaaataaatatataaataatgatgaagatgacaaagaacttattgctagggattgctgccgtatgtggcagcacttttcaggctgtagcttgtacgggaatctcgctgacatcccgtgacggcagttatgtgcaggcccgtacgattgaatgggcgcgcggtgtgttgcaaagcgagtatgtgattattccacgtggtcaacagctcacgtcattcactcctacgggtgtcaatggactaacgtttacggcaaaatatggagtggtcggtctggctgttgtacaaaaagagtttattgccgaaggaatcaatgaggcaggactttcggctggactatttttctttcctcattatgggggatatgaaacgtatgatgctgcacagaaccagcggacactggcagaccttcaagtgacggagtggctgttgtcgcagttttccactattgacgaggtgaaggcagccctttcttctgtacgtgttgtaggactggaaaagacagcggtagtacattggcgtatcggtgaaccgtcggggcgtcaggttgtattggaaattgtaggtggcgtaccgcatttttatgagaatacagtaggagtgttgacgaatgcccccggttttgaatggcaactcactaatttgaacaactacgtcaatcttcatccgggtgacgcttccatgcaaaaattgagtggtattacattgcaacctactggtggcaactccggttttctcggtattccgggtgatgccacgcctccttcgcggtttgtacgtgctgctttttatagggggacagctccgcaacgagctacaggctttgataccgtgcagcaatgtttccacttgcttaataattttgatattcctattggtatagaacattcgcagggtgatattccggatattcccagtgctacgcaatggacctcggctatcgacctcacgaaccggaaggtttattataaaacggcctataacaattcgatacgttgcatcgatttgaaggctattgatttctcaaaggtaaaatatcaatcacatccgttggataagatacaggagcagccggttgaaatggttaagattcctcggtaaaatacggaacggtatggaggtgctcttgtataatagttgctcgcattaagaatgttttcaaataaatgttggtgacgttttaccctcacaccctcaccctttgtgctcaatccatttattcatcggggttacaggtgtgagggtaaaggtgagagtaggtgagggtaactttttactctcactctgtctcgtcctgatttgagttgaccaatcttattccgttttcacactaacttctttattcttaccataatatccacttcccggcacataaatcggctgcatggctccacccatatttttcaatttaccctcgtcgcgcagacgtcggatatgtcgcatggctgtacttcttgccattccgcaaagatattggaagtcatgtcttcgcataaatggatgagtacggaagtactgagtcagttgcaggtcaatttcttcgtttgtcagttgggtgaaatccagtcctcctttgaggcttttcactttaagcacaccgaactcgtttttcaatgtctggtcggcacgaaactgaatggcctttagcttcactttggtcactttccgttttgtgtctaccgttacaggttccgtggttgtcaggcagggatggaaataaccgatgccgtccagatgaacttggcgtccttccgccaattcctgtcccatgatgtgcgaaagcgcatcaagtacggctgtgacgtctgtttctgtcagtgaacaacgttcttgaatacgtcggcgcagtacgtcggtccctgtggaaccgttgtatttgatgcgcggatgcagggtgtttccgttttctccctgctgtttgtttgaaggcttcgggtcttcataccaatcgaataatattgccatagctctatatttgttttaaatgaactgttcttgttatgtattctcttagatagtaatacattaatgcttaatgtttcttttgttaagctctaatgctttgcaagggctcacccatgtgaacaaggctgtttacgtctgtagacgtttttatttacaattgatagcctgtttgttcacacgggtgagcccttgacaactactaagcaaagatacataaataataaggcaaatgcaaataatatgcaggtatttatcggataaaatgcttgtttaccggaagataaaagcgtatctttacaggaattaaataggtagatgtaattgtagaaaaaatagacaaaaataggatgaaaattactttaatcagacaagacaacgggagcggaaaagagactcttagcatttgtgaggcaggcacattattcgacaaaatgaaaacggaaaccaaagcggggcatatcacggctttgcgggaaattataccgttactggaaggtacgtatgcccggtacgaacatatagataagttgccatacatttattctgctgtggaatatacccggaccaaagagggtgaacggaagatgaagcagtataacggattggtacagttggaagtgagccggttggccggtgggtcggaagcggaatttgtgaaacggcaagcggcacttctgccacagacttttgctgctttttgtggttccagcggtcgtagtgtgaagatatgggttcgttttgccttgccggacgatggagggttgccatctgaagaggcggaggcggaactgtttcatgttcatgcttatcggctggctgtgaaatgttatcagccgatgttgcctttcgatatcgatctgaaggaacctgtgttgacacagaaatgtcgtatgacgttggatgaggctccttattataatccggatgcagtgccgttttgtttggaacagccgcttacgatgccgggggaagagactttccgccagcggaagcaggaggagaaaaatccgttattgcgattgcaaccgggatatgagtcggcacaaacgttcacgaagatttatgaagcggcattgaacagggcacttcaggaaatggagaactggaaacgtggggacgacttacagtctttgctggtccgccttgccgagcattgtttcaaagcgggtgtccccgaagaggaagcgatacggcagacgatgattcattattatcgcgaggaggaagaacaggcgattcgttcgatactccataatctttaccaggaatgtaagggattcggcaagaaaagcagcatcagcaaagagcaggagacggcttttctgttggaagagtttatgaaacgccgttatgaattccgttacaatacggtgctggatgatttggaatatcgtcagcgtgactccgttcatttttgctttaagccggtggataaacgggtgcgcaacagcattgcaatcaatgcattgaaagagggaattagtgcgtgggaccgtgatgtggatcgttttctgaattcggaatgtgttcctttgtacaatcctgtcgaagaatatctttatgaggcagggcgttgggatggaaaggagcgtattcgtgcattggccggtttggttccttgtgataatccgtattggcaggaattgttttaccgttggttccttagtatggtggcgcattggaggggagttgaccggcagcatggtaatagtacttcgcctttgctggtcggttcgcaagggtatcgcaagtctacattttgtcgcattatcctgccgccggaacttcgtttcggctatacggacagtattgatttcaagagtaagcaggaggcggaacgttatctgggacgctttttcctgattaatattgatgagttcgatcagattaatgtcagtcagcaaggattcctgaagcatttgttgcagaagcctgtcgcgaatttgcgtaagccttacggtaatacgattcgggaaatgaggcgttatgcttcttttatcggaaccagcaatcagaaagatttgcttaccgatcccagtggtagccgccgtttcatttgtatcgaggtgacggctcctattcaaacgaacgttaccatcaattacaaacagctgtatgctcaagcgatggaggcgatttataaaggggaacgttattggctgaatgatgaagatgaaaatatattgaaacagaccaaccgtgagttcgaacaggctagtccgttggaacagttgtttcattgttatcttaatccggtagaggaggaaatggaaggcgaatggctgactgccatgcagattttgagctatttgcagacgaaaacacgggataagttggctattagtaaggtgggacagtttggacgcgcacttcagaaactgaatattccttgtcgtaaatctcgtaaggggacgctttatcatttggtaaaggtggagtagtttaccctcacacttgtaactccgatgaataaaggattttataagaatcgcaattttcgggttgtttatcagatatatgtgtggtaattttgtggcattggaaactaaaatggatttgaaagtcaaaatatgatggattgctttttcagttgtaagtacaataaatgtatttttgcaggtgtggaaaacaaaagcagtgctatcaatccccgaaaataagttaagatggaagataaaaggaaagaaatagttggcaatgtcattcggatacagtgttatcattctccttgtggcgatttgatgcttggctcgtttgaggatcggctttgtctttgtgactgggcggttgaaagtcatagggatattgtagacaggaggttacggaaagtgctgaaagcctgttatgaagaaagtacatccgaggttatacaggaagcgattaagcagttggacgaatatttcaatggtgaacggactgtgtttgaagtgcctttgctttttgtaggtacggattttcagaaaagtgtatggtataagttgctggatattccatacggttcgactgtatcgtatggagaattggcaaaacagctggatatgccgaaggctgtccgtgcggttgccgctgctaacggtgcgaacgctatttctatttttgctccgtgtcatcgtgttatcggcagtaaccacacgcttgtggggtatgccggtggtcttcctgctaaaaaacggttactggatttggaaataaacggcaaacctctgttatgaatgagcaagaaacgcttgattatgcacgtattgcacaggcaatcgggtatataagggagaatttcaaaaggcaaccgggactggatgagattgcccgggaagtggcgttgagtacggcacatttccaacgtatgtttacggagtgggcaggggttagtcctaagaagttcttgcaatatatcagtattgaatatgccaagaaaatcttggatgagactcatgcgtctttgtttgatacggcacaggaaacgggactttccggtacgggcagattgtatgatttgtttgtaaatatagaaggcatgacaccgggcgagtataaaaacggtggtgaaaatctttctatcaattacagttttgccaaaagtccttttggtgaattattcattgcatctaccaataaaggtatttgttgtctggagtttgcagacgatcacgatgcggcatttcattccttgttgaagaagtttcctaatgcaacgtttactccggctgtggatgagatgcagcaaaatgctttatccatcttcacgcaggattggaggaagctcaaagatataaagctgcatttgaaaggtactgactttcaactaaaggtctgggaaactttactgaaaatccctgtcgccggattgactacttatggagatatagccgcaggtattaataacccgaaggcttgccgggctgtaggaacggctgtcggtgagaatcccgtagcttttcttattccatgtcatcgtgtcattcgttcttccggtgagttgggtaattaccactggggagagattcgaaagactgcaattattggttgggaggctgcgaaaaatggatatttgaataaatagtaagtactggcggtaagaaaagtcagaaacgggatatcgggttcttctttcatttataaatcccggctcaaggatgaaaccgcaaagccgggatttatttgtagtcgaatgactatcattcctcttcttcatttattccttcatagcacctgatatccgcttcaatcatgaaattataaatcagtcgggttttaaacatcattctctcctgcgacaattctaaatcagcaagtgttgcttcgattctattgcagaattcattaattctttcttcttctagcatcggatacatttcgtaaactcgccggacgaaaggtaccatcgaagcctgcacctgataaagtagtatttggggttcatattggaaatccacttcgtccatctgtttatgcaagtgctcgttttcgtaggctatttgttgaaactcttcgaaacaaggtaaaagctgctctgagtgatgaagcagtaattttatggttgcaatggctgcaaaacctttttccagttcatttccatattgaaaatggttatacagggagcaaaatgatgcttccagacagagccgttcaaattcggtgtcttttacccacggaagataagtgagcataggcaggcattcacctagcgtaagctgatctttacagtcaagtattttgataagattacccggtcgggtaaggaattgatacatagtgtgcatggccaggtatttttccgcaagccggtcctcgtccaattcacgagatgcttccaattcggacaacagaaaatcgatattctcctccttgttatctggttgttgctcttcggcacgtgctatgtcttcgtcaagcatatttaaaatttcctgaatattcatattacattattatttttatacctgtttattattctttcttagttttgggcttgtcttattgcgacaatgcgggtattatagggctcttgcatactgtcgggcaattcctccaacaatccgtgaagttggtcgatcaatttttctgcctgttcgatgttgcctgtttgaagcatataatcaatcaattcaatgccgatggatatcctgtacaaaaggtcgttgctctcatctttcagtagtttcatggcagaatgtaccagttgcgtggcatccatttcgctaccggacaaatagagtgcgagagctttgtggatagtcataggcgagattcctgtatcggttttgtcagcttcgtaacgattgaaggcgtccagggcttccttgatatgccctgtgtcaagaagtatcttaccgagaactttgtcaatttcgggcaatgtggaaattgacggatcttgctctatggcattttccagcatctgaagagcctcttgcgggtggcttaatgcattgtaacacttggccagtggtacgatgagattgggttcgtaagtcaggttggtttcatagagcggtagggctttatgatattgcatggtgtcgcagtaggcatttgctatcgttatctctatttggctttttatttcgtcggaaggaggctgtgattcagtcttctgtagcaagttgagtcccgccgtgattaccctgtgcggattatccaaaacggcatccattgttattcttcgtaaactaatcaggtaatagccgtctacggttattccactgtttgcggctatttcttcaagaaaagagatgtacagttgatgggttgtattgtacatgcctaagccgattgtgtaatccatcagaacaattactgcactttcgagatcgattcggtagttttggtcatcaaacgattcgtcttcttgttttagatgttcaatcgacgtaccgattccattgcttgcactttggtgtgactgcttgtattcttcgttattgctggagaggacataaacaaattcgaagcatcggaggatgacttgccagtatacagtatcttgtttggttatggcctgcgctatgttgttcagacatgctatcgttttcttgttgtagaagccatataaacttagcaagcatcgtatttcatgccagtagctcatttctgcctgctcgaaattacctcgattccaattgaattcggccatgtctttgaatacccgttcggccacagcgtcattatcgttttggatagcgatgtcggcagccatacgatagtattcttctgcttggtcttcttcctttttcatttccattgaataagccagatagcgataaatcaggcttcgggctactgacattttttcaactcccttttggttgcaatgatgaagggcacgattgaacatgtcgacagctctttcaaaataacccgtctgaaaggcgtctctcccttgtcggaaggtgtcggtcaatgccggatcatctataccgatgtaggttgcaaattcttcgatttcggcatttgcattggctatttgcttttcattgggttggtcattggccgaatcttctgtattttcatttgcctgtttcagttggtcaactgtgtccttgtactgcctggccatctgatcgtcgggaccgaacagggcggagcgtatctcccaggctttttcaatgtgttcgattgccttgtctatgtgtcctagtctgaaacatattgcaccgtaattattgttcgcataggcagctgcttcatcctgacttttatcgcattcttccagcaaagcaagtgatttttcgagtgcaactgcggcgtcttcgaaacgattgaaagtgttgtatgctgcggccagataggagtatgaggcagcctctttttccaggttatccatattatgccaggtttcggctcctttcagataataatgttccgaaagcttttcatcatttaggacgagatagactttacccagattgtcatacatggtagcagccagttttgagtctgtttgttttaatgtttcgagtagactgatgcactccaatgctgtgttgagagacagatcaggttggttggcccgaagatatatggaggcctggctgttcagtagctcgaccagcgtcatgtcacggtctccaatcttttggtaaatatctatcgcatgtctcatatattcggtcgctttgggatagtttccactatacatctcaatttctgcaagcgagtgatattcttcttgggtatgcgtattttcatctcctaatatgtgctgatatatcgtaagggctttttcggcatactctctggcttggtcaaaatcttgttccatgcggcattcgagtgcataattatgataggcgatggctacatcaatatcattctcacctttgagactgacatatatgtcctgacttttcagacgatattccttagcaagttcttcttcaccaagcaacctgtatataccggcgagattatcgtatgctacggcaatatcatcatgcatgtccggcaggatggatttgcgcatcttgaggaccttttcgaggatcagcttcgctttttccaatgcgttcttatcaaccggatcttgtgattcgccgatactgtggtatacatcagcgatgttacacaggtaagatgttattttcaggtcgtcttctccgtaagcatggactgcaagtgataatccttccctatattcctttaacgcctggatgtactcttttttgcgaatacagatcataccagccagattgtggaacgagcagcgttcttcactggtatcgccgtcggccatctggtcgcacatacggattaggaattctaccagttcgtaggctgcatccaaatcattcagataagaaatacagatgttggtcagccggataacgtctttgcggaacatctgccaataagcccattgtagcataactaccatttcagccttttcagccatacttcccataatctgttcaatataggcttgtgaaattttatattttgaagcatcggcttgttttagtgtacgccagtaaagtatgaattcgtgaatgttgttggtgctaaactgtcggctcatatagccgagtgttgaaatacattcgtggagctcgtcccatttttcggcgtgataaagttgataggggagttcctccatcttgcggaagttattgttttcttcgcgattgaaatagtctattatgttctgtcttaattgtacttttctttcgctgttaaggtatttctgttcaatggcctgtcgtatcatgtcgtgtgcaaaaaccactcgtccgtccctaatcattaggtgagccgtgtttgcacaatagaattgagaccagtagagcgacgggatgttgctaattgcaatcagttctgtttcagataatccatctttggataatgctatcagtgacagcaagtctgatgttagcgaggggtaaagtggtgtgttgtatatttgctctttgcgctgtaatagtctgtcaaaaaacgagttgatgtctggcaggttagtcatttggctgatgaagctggtcaggctgtcgaaatttccgaaacatctgatttcctcaagtaatgacatcagtaccatggtgttgtctgttatgtcactgcctttgagtatcatggtcagttgttgttcggacagccgcttgcgataacgatcgaaaaagtctacaatcagttccttgcgttggtcgagcagtaaggggtagactgttattacagggtatttccgttttttgaatacctgcatggttttatcttcctcgatagttgaaaagattatttttacattgtccgggaagtcaggcaaccagtttaatagttttgttctatgattccggtccgaaagttgattggcgccgtccaaaacgattagtaaaggtttttgtccggcaattagttgggccctcaaggctagtttctggtaatctatattatctgtatcggtagcattgtgctcgatttgtcggtcgttttcctccatctgctcaagtccgtatagagagtctatctgggtggttatatgcttcgcaatatccgtcgtgtccaaattctgcgatgagttggcgctaaagtgtgctaccacattccaccgatcatcttcgatgatatttttaagccaataagccaaaagggcactcttacccataccgctttctccggtaatcaccagatgctggttggttgtatcgtttagaaacttgtccagataggagatataagctttattgggtatataattatccgatttgtcatccagaaaggcttgtagtttctgtctttcgtgtacggcaggatcctcgactttatctttggggaaaaggtggtcgagtaatgccctgaattccgattccacctgttcgcccaattgttcgggggaacagtaatcataggtgttatatcttttgttatttcttactgtttcttttaactgcgcctgccttgggtcggtttccatcgtcttttcatccgcttcccgtatatagaacgaagcatagaccggttcgagcgaccggagtacgccatattgaatttcaatttccgtaatactcattccacgatcgaggtcagcggcaagccattcatatctgtcaggcatggcctggtgttcaatgagtgtttctttcgatggacaccaaccgtatctttctcctaataatccgatgaaaaacgggtgtgagttccgtatctcgtccaagcatatttccactactttgcttgattttgcttcttcttcggtgattccccatcgcagatcgacttcagtcagtgtgacattgcgttcgtaggcaatctgtcgcagtcttggaaaaactttggtaaccagcatatctctttcgctctgcatatcttgaaaggtggatgaaataaatatccttatgcttcttgatttctgaaatttgtttctcatagtatatgtattaatctaatttctacaaattgtggaatggaaccgggagcttataagaatctcatttactgcatttttatattctgtcctgtcattgaatactgagattttaaatcttgttgccccttaatacaaacatagggaaaaactttgatttgtcatagcaattttgtaaaaatgtcaaatcttgcacttttcgaaattgcaccaataatgatctaattttgtgtacatttacagaatgaataacttgaatgatatgtaaattataaaacttccacaactggattcagttagtccaatctgcattttgataatcttgcagagctatccactggtcattatcctgacgataatcggggggctatctcctataatcggatggtgttacttttaggtgttttataaataatctgcgcatattgtctatattcatcagaccacattcaagggaaattgtttctaaggtatgttgagtttctgtgagcaaacgacaggcggcttccagccttagtttctcgacatatttagctggtgttattcctgtttctctggtaaacacgcgtgcaaaatttcttggactcatcagtgcttgttcggccaaatcttctactgttattttttcttttaaatgttctaacagccaatctttaatattctggataggcttgtaatcgctatcctgatgttttagagtaacgctaaattgtgcttgattacccggtcgcttcaggtagacgacgagttctctggctacttctaaagccaaagttcgtccgaaatcttcttctattaatgccaaggccaaatctattcccgaggaaactccggctgatgtgtatacatgtccgtctttaataaagatagactcgctgtcaacatctaaagatggatagtcattagccagcttgtggcataatttccaatgggtagcgacttttctgttgtcaaggatggatgcttccgccaaaatgaaagcccccgtgcagatagaacagattctccgtacttgcatggattgttgctttatccatgataatgtcttggggccaaccatgtcttcaagactttcgggaataccgggaatgaacagcgtgtctatggggtaattcaacgacttgatagaaccttcgcattgcaggcaaagccccgatgatgttttgactatcctgtttttatctaatgataatgtatgcagcacatacgtagtgtctttatgataagatttcaggcattgtatggcgagtgaaaaggcctcatagggacctgtaatatcgagcaatgttgcattgggtattacaagaaatgcgatgtgcttatatcttttctccatatatggtcttttcaatttttactgtgaacaaagataatataaatatggcagtttttgacggaataatgtcatttcaggctatgatgaatatgtctacctttgcagcattcataaattgtttaatatataacccgattgattatgaaattattggtattccttgctaaagggtttgaaacgattgagttcagtgcttttattgatgttatgggatgggcaaagacggactttgattgtaaaatcgatgttgttacctgtggcttgaatagaaaagtgattagttctttcaatgttcccgttttggtggataaagtcatagatgaagtatctgcggatgactatgatgcgcttgcgatacccggcggatttgaggaatttgggttttatgaggaagcatataatgagcaacttttggagttaatacggttgtttgattcacaaaagaaatggattgcaacagtttgtgtcggtgctctacctgttgggaaaagcggggtcttgaatggccggagggcaacaacttaccaccttaggggtgcacataagcagaaaattcttgagggttttggagcaaccatcgtgaatactcccattgtggtagatgataatatcataacttcttattgtcctcaaacatcgtatggagttgcattgctgttattggagaagttaacctctcatgaagagatgggtttagtgaaagatgctatgggattttaatggattgttgttagacgttttttattatacagaaaattatatctttgtatttcaaacaactggaattatgaaatttatagcagaggctaatgtctcaccataaaaatatgaatattgagaatgataagattacaataaagcctttgcgtgatgaagatgtagacactttcagcaaatggctggctaaagaatatattaataaatggttctgtcccgatggagaagagcataaggcggcttggttgaatgaaataaataatagaaatacccaatatcattatatgaatcacttcattgtctattataatgataaagctattggtttctgtttatacttggattgctattttgaaaaagaatatatcccggaacattatggaagaactgttgataaaaaagagacagtctttgaaataggttacctcataggtgaagaagaatatttgggtaaggggtttggtggagttattgtaaaaaaactgattgagaaaattgcagaaataggagggaaagagatactagctgatcccgatgaagaaaatattatatcaataaggacattattgagtaatggatttataaaagtaaaagattgcgattacagatactgtcttaaataagtactgtggagaaagaaacatttcttatgctctgaattacttaattgtgaggttaaaatctggatttatgataatatacaggtgccaggattgactccatagcacctgtacatattgaaattcctacttaatatcccggattctggtactcaccgccattggtgatcgtggctgtaaaagtagttgaaatgggacgtaacgcataattcggatggaagaaccggaccagatccggatgagtattctccagatattccgagttcttaaacattcctgtccgtttcaagtcatagaagcggcaatattctccgcaaagttcacggcctctttcgtctaagatatcccgcatcgtaatactccctgtgagtggatttgctccggcacgttcacgaaccttgttgatataaccggctgcattcgcaccgccattcaggtaaatatctgcttctgccgcaatcaaataaacttctgccatacgcatgataaatgttgcattcagattaccgtttctctgtttggaagcattggctacataataattactgctgttatgtttattcagtgacggataatagtagcggaactgattttcgttcgtgccgtcattcttgtaattgcctgtgacgtttgtataagcataattcatgttcacattatgattgtcatcactatatacatgatgataatcaatcagcaaatgatctgaaatatgttctttttgcttctctgtagcgtaatccatgtcttgcggcatgatgaatttaatggctaagtcacctttattcagggctttgccgatgacggcttcttccttatcatacatgtgcacggcactttcgtcccaggtgtaattcttgttcgcgttccactctgtagtgaacgattcgtgaaatctggggtctaatgttccgtctttctgcacatacaaactcaataaatgctgcgtaggcataaagataccggtaattgaaccttcccaggtaagccgtgtctcctgattgtcttcacgtgcaccgaatttattgatattacataagaaatactcgtcgttgcgattcaacttgtaattcccgttgcttgatccgtgtccgtctgctcctgcataccagcgatgtttccagagagcttccttgttttcccagttgttactctctttaaacacctcgctatacgatggatacatatacgtattgtatttcccaccgccagtttcgcaatcggtaatcaatttcttggctgcatccagagcttcctgcaaatattcggtgcttccatattcgtacgtctgcaagcaggctttagccagaaaaccgagagcggctttctttgtcggagtggtagttgttgcatgcgtacctgttggcaaccattcggatgcaaatctcaaatcggggataataacttcctgatagatagtcatcggatcggtgcgggtgggggagtaagtcagtgtttccgttactacgggttctgtgagcattgtcactgctccgaattgttccactgcattgaaataatacacagctctaagaaaacgggcttccgcaatctttgcattccgttcctcttccgtggtgtaaggaggcttgtctcctaatgcgatagcttcgttacaggctcccacaccatcgtacgtcccgttccaccaattattggtgtaagtcgtattgggcgatgttcctgcgaaaaaccagaaccactgcgtgtaactggttgattcattggctttatacgtccaaagatcggtgtcaccttcagtcagtgacatccagtcggcagcaccataataaaacctttccatggcaaaataacactggttaatcagggtttcatatccatcgatggaagtagccaaagcctctttggtaaatgcacccgggttgtactcgtccaaagtgcaggagtgtagagacagggccgagagcagtacgctgcaaaatatgaattttatatatatacttttcatgattataatctttagttagaatgtcaaattaacgccaaaaacaaattgccggtaggtagggaatgcgtccgaaccgttggtttcgggatcggtatctttcaactgcttgtcttttacgaagatgaacggattgtaggctgtggcatagatgcggcatttttccatcaaaaccttgcgtgatatgtttacgggcagtgtatatcccagtgtgatattcttaatcttgataaaggaaccgtcgcgtactcttaatgaaggatatacggttttttgctcatctgccgttccgggacgggggaaataggcgtcctgattatcctctgtccagtagtctacgcctgccagctgattcttggtaacgctctgttcggcggtataatagccgagcaggtcactgttgatcgtctgtccgtaacgcgccatggcaaagacagataaatcaaaattcttgtaggtgaaggaattgttgaatccgatgatccagtccggattggaatgtcccagaatttgccggtcttccgtgctgtatttatgtacgcctccgtcacctttctggtctaaggtctctatcttgatgaagccgggttttacgccgtaggcatctaatgtttcctgcggagtatcggttccccagattccggcatacttatatccgtaaatggctttaatcggttcaccgacaaacaggttttcagcaatcaggtcaccatcaggtagttcgtctatttgttccttgttccaggtgacggataaagtcgtgttccaggtgaaatccttgtgccgtatgttgtgcgaagtgatcgttgcttccacaccttgattgctggtctgggcgatgttctgccagatggccagaggcgatccccatccggtcagaccgctggtaatgggcaatgtacgtttgaataataatcctttggttgtcgtcttgaaccattctaccgagccgtcgatgcgaccgttcaggataccgaaatccaaccctatattccagttgtatgatttttcccatccgaggtcggaactaccgtaagtaccagagtactgtgtgaaaggaacgatcttcccgttaatggaaattcccgaagcggtatatacgtatgcttgtgttgtggtactgtatgcggtggttcctcccgagttacccgtgataccgtagctcactctcaacttcaggttgtccagccaactgcgtgtcttttccataaatgcctcgtccgatattctccacgccagtgcgcctgcggggaaagcatcccatttatgtccggtagaaaattgtgaaacaccatcccaacgggtagagaaattaaacaggtatttgcccttgtacgaatagttcagacggaaggcaaaagacattttctgtgtctgtgcgaagtcggattccacatgttgggaagtacccgatgtcagtcgccagaaagaccattgatctaccatctgaccgctggcggcagccatgctactttccgactggttcttattccaggaagtaatcagtgaacctcccagattatggtctttggcgatggttgtgttgtaagcgagaatattctcccaagtgtaattccaggcattgttgttggtgatggaagcatgcggtgaacctgcataagacggacggttggcattacacttctctccccagtattgcccgtggcgtgagtgattcaaagtaccattgacacgactggtaaaagtcaggtctttgacgggagttagttcgacatagccactcatgttcaggtaggtggaacgggtgttgtctacatactgattctctatgaaatcactcatcggggaatattggcccgtgatgtattcgtgattgatctcctcttcttcggtataagcatcacccagcgggatggcggagagagatttggtgaatgtgtttttcacgccggagttcaagtcacggtagactaaattggaagtaaagcccacctttgcccacgaaaatatctgctgatccagattgaggcgtaacgaatatctgttcagattctcgttactaagtaaaccttcctcccggttgtaggaagtcgaagcaaataattttgtcttttcagtgccgctactgaccgaaagactgtatttctgtgtggtagccgtgttgcccgaaacttcatctatccagtctatccatttgccgtcgttgtatgcatctataaaatcctgttttcccagtagggcggacatatcggtgggatagtcaccgtttttatatttataggcttcccgttgataggtgatccattcatcccgtgtcatcccatgtctgtagttgggtgaaccgctgaatccgtaataagcatcgaaatttacggtagcttttccctcttttcctcttttggtggtgatgatgacaacgccgtttgctcctgcggaaccataaatagcggtggaagaagcatctttcaatacatctacactctcgatgtctgacgggctgacttggctatagctgccggggattccatcgataataaacaacggttcgttgctgccatagatggatcgtgaaccacgtaacaggatagtgacatcacctcctacctgtcccgaagttttggtgatatccattccgggtatcttaccttgaagggcttccatcacattattggtaggagcggccagcacttccgcgctcttgacggaggttactgcacccgtcaaatcccgttttttgaccgatccgtatcctaccaccactacttcatcaatcagtctggcgtcttccgtcagtatgatttccaccttgttcttgttgcgtgtattgacttcctgttccgtgtatcccatataagatacctttaatattgcattgggtgctacgcgcagtgtgaacagtccgtctacattcgtaatcgtcccgttactggtacctttttcaacgatattcgctccgataatagtctctccttgagagtttttcactataccagagatcgttctgctctgttggcaataagcccgtgttgatccaagtatcaataatgaatctattaataggaataataggtaaaaattcattttataaacagtctttaggggattattccaccctatgtttgttttatcagaaaatgatttcatgctttttgtttaattgtatgtttactaatttgtttttggatagctaaattttcggacaatttaaagctatgtctcgattgtaacgactttacttaccccataggctattagattttattggttaaatgatgattgttcagaatgtcaatgtcaattgaatatcattctgatactgttttgaatgtggcgccacgattcctgtcagtaaaaaactgacaggacaaaattatgcatatagaactggggattgaaaaaaataaagttgactttgatttgatttgggttgatttttactatctttgtctcaatgtactacttaaaaaaataatgatatggatatcgaagtaaaagataaagcgaaccggagacatgtagggcataatctgcaaaagatccgtgtttactttggtatgaagcaagaagctctagcggctgatcttggtgtaaaccagcaggtcatctcaaagattgaaaaacaggaagaaatagaagaaggtcttttaaatcaaattgcttctgtgttgggaatatctgcagaagtgattaaagactttgatgtggagaaggctatctataatattaataatatcagagacaacacctttgaacaaggttctacatcaatcgcacaacaattcaatccagtggataaaatagtggaattgtatgaacgtttactccaaagtgaaagggagaaagtggagttactgaaaaataagtgattataaattagtagattgagataagttaaaaataaatttattattatggaaacagaatcttatacaaacaattcgcatttgggacggaaaatagaacgaatacggcgtcttcgtggtatgacgcagactgatttgggtgaactattgggagtgactaaacaggctatttccaaaatggagcaatcggaaaaaatagatgacgataaattaaaacaagtagctgacgcgttaggtgtcacggaagatggcttaaagaaattcacggaagaaacagtcctatatagcacaaacaatttttatgaaaactgccatgtgagtgcatctaatataggtcctatcactcatgtggaaaatctcaatcacttttcaatggagcaagctgtgaaattgtttgaggaattgttgaaaatagaaagagaaaaatatagtaagggaaaagaggatagtaagtgaaaaggtaatcttttttagaaagaatgtagaaaaaaagatatttggttattcattcggatataactaagatttcattgaaactttataaatagtgttttttactataaatattgaggtatccaaactctttttagttcaaggagtttggatgcgctatttttaagtttactgcactacagcatttttcacagcataaaagcagctatttcgtgtggtaagatggtacttttatcttcatacctgaaactttgatgaatagggagattaacgcaagggtgagagtatgagggtaaaactgataaaaacttttatttttgtattgatacgttgaatcaaatattctagttctatatgtaagtatagctcgttttttgttttattatatgggttttatactgggactttgtattttggatgttgagaatagaccgcagcattcatgctttttagaacatttagaacaagcatctatatagcagactttccaatcagaaatcgatttttttgcgaatttgtataatgatggttttagtaaacaaataggaatgttgaaaatagaaacatctagtttccattctgctaaatttacaactgccttttcaagctctttttgataatcaatcgggtcgatccaaactttattgtgatttttgatcgaataaccagtgtcttctaatcccatgaatgatatgtatgcaacaaatggtagattcttccatataaattcagataattggggtagtctttggtaattcattttgttaatgactatacgcaattctatgtctgcccctatacttgcgagattatataatcctttcattgtttctgtataagaaccctttacttgtgttatggtatcgtggtctattgaaaagtcagagtgtaatggaatgccaaataaaagattggaaatttctttaaatttcatggtatagcgaatgtctgaaaaggctctcccattagtaagtatatgtattagactctctggataacgaagttttatatattcaactaagtgtattaatttttcttgcaacagcgttggttctccaccagtgatccctatattagttaatccgttgggagcattgtctattagtttgatgtttttgttccaaaaggaatcgatgtcatccctgtttaatggtggttgtgcacacattaaacatctgttattacattgtgaggtaacgaacagtgaattatcattggaatttatatcaaaattcattttcatttctattgatccattgtttgaatattggcataaccctatcatattcattctgaattaagtagaatatataggtgataattgctttgtgttttttgcacaaagaagaagtaggacgaaaaccatacatgtcattttgagcagagtagtttcgtacagggtcagctccacagtaagattgaaaagcgcaatcggcacatcctgcaataaattcagttccccaaattagggctatttgttgagcctttcttccataaaaaatactttcatatttatctgtaacgtgtcctaacttgaatgtgttgtcattatattctgctaacatccttgattcatcagatgcatatacataaccatcgtaattataaacaataacactgttgatgattccggagggagattgtaaatcaacaaaacctgttgtaaaaggagtaagaattttacgtaataatatggaggtgaattcttcaacaaagaatcggccttgaatatttatgtcaataatatagttcaatgcagatttatagaattctatgaaattatcgaaatatgtttcccaatttgtattgttaagagctaatccataaggatttagggggcgaagaaatatattattaaaaccattcgacaaataattgtcaataatctctttgggatgatttattgacaactctgatgtggtcattagtgctgatattctgtctgttcctaaataattcctagctttgttaattccttctattacacggttatagctatcagcttttcctcggttatgattatgaatgaaagctggaccatctagggaagttgagataagtatattatattctttgcaaagtgatagtatttcatctgttaggttgatggagtttgtgcataaaacatatgttatttgtttcttaaattcttgatttaatgcaacagttctttttactgctttctgtagtagttggaaaggtagggatggttctccaccttgaaattccattgtaatggagtgtgatgggctttgaaacatcaaatctatggctttgaaaagatgttcttctttcatgtcatagatagcttcacagctttccttgcttgaagcctgacaataaatacaattttgattacatcttaaagttaagacaaaaatgtgtagtgatgtaaataaatcgagaaaggcctttttagttcttagtcgtgttgctatattgtctattagctctgggataggactttcagagataaagaagttagcaactaaatccttgtaaagatcctcttgattgttaagttggcgtttgatgattcgttctgtagtgcctgttggcacgaaaatgaaatcacccaattcattgacgagtaattcttgttccttgattctttcgaagcggaatggtaataaatagtagtgattcattattccgatgctaaattaaaatcctcaaaatcatcgttgttagcaaaagcctttacatataagatgttacgaatatctttagtttcattagtaatcaaatctctgtttttataatcaattaaatcttgattaaatttatgggttacatattcaaatgtgtatatcttgtttgcgcttggtttaagttccaaagttatttcaaataaattatctttgtttttattccaataaataataaatgattctgcataccaatataatgctttggtcaatacacgctcattgaatatagaggcattgattgtaaaacaaaatgtgttttctgaccttaattcagccttaatcataattgaatattacttttttagaaaatatactgtttgggtttctacaatgccatcagcatctattcctattgatttttggaatttaataacggctttttctgtttcttcatcaaaaagggaagttcccttgagtagttttccagataaatatcctttgtcgattaggatgtttttaagttgggttacatcgtacccttgcatttgttttttaagtatgcggtctcctaaattatatttttgaacgtccgtatttactgttttacgatttattagttctatttgtttgttaatagcttcaattgttttctttccaacaataccgtctaccacttgattatgatccttttgaaatttcttaatagcattttctagtctaatagaatatttgacatctccagaataattcttttctatgtctgactctattatatatcttatcttgactaatttattagctaattctgcaacatctttacctgaaacaccactaataatatttctttctcctaatgagtaagtagtctttgtgctagtcgttgtattagtgttataggttgaagtgctggagcttgtagtagttgaagaaccactatagcttccatagctactagatctgtgtgaagaatgagatctatgtgaagagtgcgagcgatggcttctatgtcctgctattaaaaatgagttgtcgttatggattttaagtatatatttctgtgagagatcattcttttttccttgttcaatgttgttgtcatcacttattcttgaaaggtcataagatatagcattggcttcgttagatgaaataagtgaagctacagatgttaaaaaaatgctttttaggagatctttaaattttgttttcatagctattgtaatttatggttacttttaattgcaaatatatattatatagatgataataaaaaattattgagtgtatattttgaaagaataattttgatatagggtatatttaatcaatatatttatttatgttgaaaaaatatataactttatttattgaagttgttgtggtgacttgcttttatttgaagtttaatagatatataaatctaaacattaagtatgaatgtatgatggttcatttattatgcgggaaattgtttatatcactttatatgagtaagaaggttaattcactttgctgtattctataacaatataattaaattcagctaaaaaagtgatatgatagtttcttacattacactcattggactaatgtacgcttgtctttcggcttaaatgtggtaatattttatactcatttaaataatataggaggctcctgccaagtataatactccgagattatttgatattttcactagtaacaaatagtacaaatagtcttttatttattctgtatcctcattactttctgtatcattattataatccatacagatataacaaaaggagcggttaaggtaatgatacccaatcccattcctaggatctgtaatgcagtggacaataagactgagcatcctgcccatactccacttttccatgtcgttcctcctaaagctatggcacataatacaccattatagcccattaatccggtatttaagtttgtagcatctacttccagcaaaatagctagaggaataggaagaagtgctcctaagatagtatagagagttgcctttcgagaactgatcgaaatgcctataagaaaaaataatccggctagaactgtatttccctgaaacatgacttgccctatgcttaaacagaaggcttggaaataattaatattctgtgtggtatcaataaccgtatcggaaactggtagtaaatctgatataagccagctacaaactcccaacattccccatacagcaagaatgaaaggagcagtaaagccagggagcaaacgttgttgactgaaaaaataggcaatccatgtggaaagggccgaagcgatagtcagcacgattaaacttcctactgataattgcagaaatacgctaaccgctatacctactaaagttccattaaatccgtataatccatttttaatatcattgcgtttatatcctgaaaaataggctgtcagtgtacttattatattaccgcagactgctagcattcccatttgccatgagtttaggaatattccaattagcattaataatccggataacgcattattctgaaacatcacttgtcctattccacgtcctagaatgagtaataaattgtgtataaagaccattacataaaatattaactgataaaatgatgacaaaggtacaacctcctattgaaactaacaagatcaatagatatgtaatagaagattgtggtgttataaattactggcaaagttttgtgagagtaggcttgaaagtctttttttaagaaaaatcccccgataatcatagattatcaagggattttcttggtgatccgcctgggattctcctattagagttaccgcgctgatatataaaactttatatttttagcttcaagcatatcccatgaattatcccactaatttgctacgtgcttttgcggtagtttgctcatggagaatactgagggcaaagatagtaaatatttgaaaactataaaatgctattaataattatgccgttttaagtatgttagaaaaagtgcttacatgaagcaatttctctaattatctattttttagatatcaactcgtgcaaaagtaaccgaaaagcaaattgagcacttgtatatgcagagtattcttgataattatcacttttatgctcatcagcaaagtcacatactgatttaatagaaattgctataggcttaggagacatactatttgccgcactataaaatactccataggcttccatctcaattccaataagctttctgctatggctctttattttatcaatttcatctttattttgaataacagctggaacagaagccattggcccaatatgtacatttaagactgttttaggcctacaagttggcaaaggaaacgccccataaatatcatctaagtatcttctttcgagttttatattttggatgatatttttaatatcatcatttaaaactttgtgacggaaatcaggaagaaagagatattcgtctttttcatttgttttaattttgccactagcgccatcccatacttcctctgcaataaggatatctcctaaatttatattatccccatcttttactcctgcagctattccagtcataacaatatatctaggatgaaaattttctattagcttcattgttaaggttgaagcagcacacattcccatctgaggggcatgtgctgctacaattttgatatcttttccattctgatttatttttgaagtataatagatggtcgaatctctaggcaagtccactttatcccactttgtacacaaggcctttacttgcgataattcgggctcagcgagagctgttataaaagcaatatcataatcaaattcaattgggcttgaatctatttctttttttgattccattcgctgtattattccctctgtcaattgtgtttcccattcttcatcaatatcgctatatctaataacagtgagtgttttgttattaaatttttcgaatgctttgtggaaaacttcatctttagatgttaaaccaattatatgagttggagttttatatatttcctttcgttgtaatatttcatctaccaaatcaattccgccctctagatcgacttgggaacttttggtttgtggaatagctatatcaacaatcattaaatcatagcactgggtacgaagttttctttttgcatccaaagcatcaattgaatgttcaatactatccacatctaaatctgagatattatttaatttagacaatacatttctaagcttattagtatcatcttcaataatcagtattctaaacataattatttaattttatttattgtatccaacaaggcactttcccaagatgtatacttaatattatattgtatagctcctaaataattaataggaaattgcttcattaatcgcaaatctaaatcaattagtgtaatctcatcttcatcttttccaaataaatcaaattgagtaacaactatagccttagacattatatgtcttcttttcatttcgtgcaataacatctcaccaccaaaagcctgagctcttccaccttgttcaatgggacttatgtcataagttggtatagtcatgtctaagattattagatcataacaaattgtcttaattgcttttagcgcactctgaaaagacctaacttcatccacgctaaaagtaaaatgttcatcaaagaacattagcaactgttcccgtttatcttcgtcgtcttcaaccaaaagtaatctcatatttaatcctccgattctaaattaaaaacttgaaatggaacttccatttctatgtggaaaatattatctacaactccaaaattcagtgtggctttaaatcgtccagccacattaaaatccatgacacttttatgtattttaaatagacctgaattgccttctcttgccaaatactcaatatagttacctgagtctaataacttttttttcgattttagattttctgataatttatcaatatctatatctgtagacaacttattgattatacttattttcatatacatgatttcattattttcatcaccctccacaatatcaaccgttgcctgtggtaaatctatacccgatctttttactacattatcaaatatattaatgaatacatctacgaatattggaagttgtccatgtatctgtaatgtggattcagatggtggatagtttattttaaagttaggggtgtcttctttaataatttcttcagcaactgcaattgcatcttcaattttgaaaggagttgaactacccgatgctggtggaacaaaccattctattattttgtcaaactgaagtgataaatctgtttttgcagagaataaagctctttcaaattcaatagaagtgcaattagacatacaggaattgacttcatcatttagttcgttgaggagttcttttgctttttgcttacagatattatttagatattctcgtattttagcaagtgaatagataagccttgtctccaaaatattgattatctgatttacacattcttctatagatgtgtctgctttaattaattgagatatttgattaatatcactatcataaaaattaaaatcaaataatccgtcaggcttgttacttttgtttatttgtaaatattggtttgctatattgaaaattaaatcatcatacttcttagagaagtagctaaatacattttcagtcctatgcttacaatcagttattccttcaagtttatcaatccagtattgattaggcttatatggtccatctttggttattctctttgtaataagtttatgtttttgtatgggaattctcattgttcgctctaattccccatgtcgaattcttgtgcttataaatctatctaatcctacctctacagataaatacatctttcttatttcctcaaaaatatatctaaacaaagatgaagcttcatctactggaacattgatgtttttttgaatagataattcttctcctactgttgagagtgtattgttagtagacatggccatatttgcaagatttatttctatataggatatatatctattaaagctttcacttaattccacattcgcccaatccctaatagcttgaatatctacatatattctacttttgtcaatttcttgacggcgacttgagataatttgtcttcgaagtaattctttaatttctagtttgtagattttctcattcttaggatctagttctaaaagtaaacgacatatagctagtctctcatctaaaacttctttactaccaccttcaaagaaacctgaagtttccataatagattctagacaaataaatcgcaaatagtatattaatttatctttgtctatcttgttaattaactgatgtagcattgaaggcttttgcacattacttcttgacaagaaatcttcaaatgcaaatcttcgattcatttcaattgattgatttgcattcttataaatacaatcaatagtaattggaaaatcaattagaccagaaatattttcccaagagtcacttccaggttctaccgcttcactaaattctcttaatggtagaaaagatgtgtgatttttttctgatactacattttctgatattatattacacaataaatcatactctccagtatgaaaatacgagtaagataagataccataccctcttcttacaaaaaaatcaagatcactatttttaattttctcagcataatttatagccttctcgtaatcctcatttttaaattcaattagagatttaatataatatgcaaattcagacttgcaattatccagctctttactatgtgataattcatctattgatttatgaaaatttactgcaatttcttcattgtatgtcttattgattatatctctatatttttcagagattcccgagtttcctataaaccaaagataatatggatgtataacattagacttgagcgtatttaatatttgctctttgtccatattttcattaaaactattttctttacacagtaataagtctatgcttgtaatccatgtaaaagtattaaagtttagatgcaatttgcttaattcattatattcctttactgaattattttttcctttcctaattacggctgatagattttcaattattatagattgtagatttttcttgcaggatatttgatttatttcattattgtatctaaatgcctttatatatgattgcaatattatgtatataggaacttcattcttatttatttcaatatttaccattccattttcagcttcttcatattttgaaagtaatatattgtcataaattatagaggttctatttcttaattgaatgatattgtttgtgataatatcatatatataatcaagtcgataatctatctctataaatgggctatggtttattgtgcttaaaactcgattaatataactatcatcgattgccatattatataccatagagatataagcttcatagtaatctatcaatgaaattgaatagctaattcttaaaacatgaacaaaatcattggtgctttgtggagtaaatccaattagatgatattgtataaattctttatagccaagctgactttctggatttaacctgttggtaatagactcaatttgacttctaaaacgattagcagttgtttgttcttcatttctaatactcacccaataagtaataaaacgagcaaggcttccattctttagttcttttctaattgattgtgcatatttcttctgctcttctaaaccttgagctaattgtagaagtgcaatcttgttttttatcaaccagatggaatgaccaaaactctcctctattttgtttaatatattaaaacatgattcatactctccaattaaaagattacttgagtattcgttagataactcaacaaagttactaatagactcaaaatgaaattgaagaatatgttttgcccacagtaattcattgttgatatctgtatacgttaaatcttctgatgaaagttcttgtattttcctatacttccccaaaagtctagtcggtaatggatttttataaagttgttcaatgacctgtttatagaaatgaggcattatagaacttcttaaggcagaaattccaagcatagactttctatgtgttggcttaatattaaaatataagccacgttcagaataattcctaataatgtcgatttgctgtgataccttgttagattctattttactcttcctattcattaacgtactgttttatttttcaaagttacaaaaatataaataaactttgtatggaatgatatcttttttttaagagactattgtgaaacatttgagtatgttgaaagtgtcctctgtggtttaaccttatgttgcgcccatcatctttttcgctgtctttttttctttttcttggggttactgaatatatccccgtaatggagatggttttgtgaaaggattacattcgatgttataaaaaaagtgagtggacttgatatttgattatttgcctgatctaaagactgattgctaagcgtactactttcttgttgagttacaatatgggagtccatattgtaaacatgattacttactttcttgttttcaagattgacagaaaacaggttttcttgattgctatcctgattaacttctactcttctttcaccagactgaatatttttttcttgtagcttaagttggtaggctacagaggtatttttcattgtgctatgataattgaatgattctgtttgttgtcgattgtaactgaacagtttatcaaatccctgttctgcttgctggaataggttcacacggccaaaaccaccttttattattccgttcttggtgtttttatgattggtaagtggtgatattttctttttgtttgactggtctttacggctcacaatcaaatgacagtgcatattcaacttattatctgaacggctacggtcaaaatgaatcttaccatagaattttatatccaaagcggatagttctttgttgaagttattggcatattcgggaatgaatatttcccgtatgtatcgtttcatagcatcgacttgttcttgttctgtattacccattgctcggagctcattttccgatgggctgatatggatagcataaaacttagcatctgtttttagtagttgtccgatattactatctatatctttaatgacttgggatttatagatattatcatttgtcagattgaaaaagccatcagtatagatacctttttccaagcgttctaaatcttcatgttccagataattggctaactgtcggctgcttccagcattgttatatattccgtttgatgatggggcaaaatcgatgtgcataatgttacgtgtttatcagattgttgatttcagctttcagattctctttccttttgctatccatcacaccgcaagcagatagttccgaatagagttgtattagatggagcaactttttataatcccgttggtgtatctggtagagtgcattaatttgtttggactggttgtttatcacatccgcatgattaccgaactgttcacttaacttttttagtacggctatttgcttctcctgactggcttccagttgagagagaataagagcttctaaagttttgccgatagcatcgaaacgaaaagcgatagaatttgttgctcgtatcatgggattcagttgctcttcctcatagtgacgaatgaagcgtataatatcatcctgtctcttatttattttcgctagttctgattttacggattcaggagcttcggaagggttgatgtgtgccttatcaatatacccgaacgccaactttacaacttcactctttttcagtgaatagcgtttgcatatcttctctgccaaagctgccgtttccttgtcaatggaaatggtagtaaatatcgtttttcgactgctgtttgtcatggtaattacttttttatagaaatataaatagataaatgcctgataataagcattgaaaagaaaatgcttattacaggtgtcattactgcgtgttcttgtaacacgctaaagccgagggatttgccccccagggcaagagggaagaacaggacttgtccagttccctcttgctcaattgagcgaaacgtgcgaagccggaaggcgtagctgtttctgctaaattggggtagaagcatagaggaatagcctaaacactggcttcttctctctgctaccttttgctttcagggctgatcggctaactgattggctttttcaaactgcttataggtttgagaatcggcaaattcacgaacaaaagcccgaatatcactcgctctatagtacgttttccgtccgatggtaaagtagggtagtttcccttttgcccgataacgttgtagagttctgaaagatgcttttagcagaaaggctaaatcctgattatccaatagtttctcatttttatctaatacggtgtcggtattgataaaggatttcaggtcttgcccgatttcggtgagtttctttgaaagtgttgccatccacttctcgaagttttcgttgtctatatacattttgcttcaattttaagttcaacgttattattttcaatcgattgatgaagcaaagttccgcaaaacaagattacagaaaaagaggagtagttacctactcccctaaaaacagtttttaaaatgttatcaatcagcaaattgaaaaatcatcttttctaatctttacggttcttacgttttttgtcttctttaataatggtatttcgtaaagcatctaatgttttggtaagattgtattgcttacgattaaatacttcgtttaccttatcataaatactaccgaatttcagattgaaaagctgttcaaagccacgagccagacgaacttctggaactggcttcccgtcttcaccaactatttgcccttgtagaaacagggcaataacgatttctgcaataccaataatccccaagtcttttgacttagggattacatatagatcggacttgaactctgtagtaacagatgaaacgaattgttcgggatgatttattttcaggttgattaattgcagttcagaatcaatcagggataatgctttgtggatgtataaatttttaagcgcatttttccccctgctcgcattgatataactcttttaggggtgctatctcaatacgagtgagatttagcgtccgaaagatatgagagtaatcttctgaatagctaattgttactatctgcttaataaattcctcataagcatctttcatttccgtattaattacttcttttgagctatcagctaataagatgaaaaacctcgtcttcaataaatcattcataggcataaattttaaattgtggataaattatttatatatcaaagtgttagctttgtatgctgaatgattccttgctttgtttgttctccaaatctccttatcttaggttatgattataaagtgttgtgtaaagcctttatgccaatagggaaatatccaaagcacattaatagagttccaatagtacttattaattctatgtcaggattgttcagaagtaataaacctacaatcattaatataccctgccatttttttatacatttttcttttattaatcctacaccctgaatgattgcaccgataggtaatagaggaagtaaatagcaaactttcaacaatccagctttatcaacaataacttgtaagaacggactgattttgataaagtctgtttctggaagtgtgtcaaatgcagataagactaaacataaagcacctttatctacagctaaaataaatgctccaaatacgccaatgatacagccccaaaatccccaattctttccagaggattgcaatccgttcatgatgcctatcattgaaactattataaagggaactgaaaacatgacaatcaaatgcccgatatgataataagaattgttgtgaaagcgttccactaaatcttgtgctgtaaatatcatcttcatctgttctaaatgggggtgcatcaagaagcccactaataacattatagggaagagcattaatgaaaatgctagtccttttctttttacttgttcactgaaagtttctctgcaaaaagatatgccttctattgtgagggcttttcgtctacaaactttgatgcaagtaccgcataaatcgcattgtgttgtatttccgatttttatatctgcttttttgctctcttgagataatacattttttaagcaggcttttacacatttgccacatttagaacactgattattatcaatttgtattttttttgtcttcatattattgttgttttagtaatatggagcaaaactaggcagaagaaaaaaaaaaatcttgatggaaatcaagacttattcgaatagaattcttttgcgtatgcgacttaatgtttcaggagttaccattatatatgaagctaattccttcagcgttattaggttgggtaaattggggcatctttgtagaagttctctgtatctcttttcaggagtatctttatatgctgaaatgatattattccacgcaacatataatagctcttctgctaaaattctaccttgctgttgtgcctccatatttgaattatagaattcgtttacatcggaatgggataatacataaacagtgctatctgtaacggcttgtatatctactatggccgactctttcttttgaaatacggaataatttcctagtggttcattaggaaagttataggcaactacatgctcattgccgttgttgtctatgcaggtatatctgaatgtaccttctataataaaacctatataggtatgcttgtcacctttatgaagaaaatactcgtttttcttataatgccgtattttccctttctctataaatatctctttaaacacagagaagtctaagcgatccatgtattcattgaattgtcccattgtgtatgatccttgtatacaaaagtgaatgttaaagagctgaaaagaaaaatccccgataatcatagattatcagggattttcttggtgatccgcctggggctcgaacccaggaccccaacattaaaagtgttgtgctctacctgctgagctagcgaatcaatccttatttgcgaatcagttatttcctgattgcgggtgcaaaggtagttacttttatttaatttgcaagcattccgtagaaaaaagtttcaattatttttcctcgttgtggcttgtttcttgattatcagtagtttctacttcatcatattttatcttttctttgttgataataaagcgttggtagtaggagagcatcaaagttgttagtggcaaggcgataatcatgccgagcattcccattaatgaaccccagatagaaagagataaaaggatgatggcaggattcagtccggtaatctttcccatgattttggggacaaggaaggtatcctgtatgatttgtacgattgcaaagacagctaatgcacatgcaatgataatccagaagttctgtccggtatcggcagctttgaggatcgccaataaaatggtgggaaggaaaccgatgatttgcaagtaaggaaccatattcaatgctccgatgaaaagtcccagagcgatagccatggggaaatcgataatcaggaaaccaatgctgaaaagaatacctacgcagaaagcaactaaagcctgtccacggaaatatctgttcataccatcctgtacgtcgtgaaccaggttggaggcaaacgtacggtatttattgggtagcagatgcaaccatccttctgctatcgcttcgtaatccaataatataaagattacatataataatataatgaaagaggcaaggatgctgaatagaatgttgagagattctgcaagcaaagtccacactctggggacggtatccttgattgccgccaggatattctcttcacttaatacacggttcagtgcctgaagatcgatgttctcgtggataaattcagaaagattcttaggcacattgtttccggctccattggtgaggtaagtcaccagcaaatcgttcattctgcctatttccgaaatcatcggcggcactaacagatagaataaagtgactccgataaccgtaatgaggaataaggaacagaagatggaaataatgcggctttttaatcgtagcttatactggaagaatttgactaacggatagatcatataagctatcagccacgcaataaagaaaggcaataacactccgctaagacgttctacaagcattaatattcctacaactaacacacatccgatggaaccgcgtataaaactgtcgaatgttatctttttcctttccataatctgtttctttatagagtttatactttctgctcatcttcccctcgcgcacggagataacattccctgcacagaggctcatattcggctgtttcgcctaaaagaacctgtttctcattcttgactgtacgatgtgagaaagaagctagctgaccacatttcacacagatcgcatgaactttggagacttcatcggcaatggcgcacaattgtggcattggaccgaacggatttcctttgaagtccatatccaatcctgcaatgataacacggattccattgttggcaagctggttgcatacatcaatcaaaccactgtcgaagaactgtgcttcatcaatacctactacatctatctcggaagtaaacagtaaaatgctggctgacgaatcgatgggagtggaggcgatagaatggctgtcgtgagagactacgtcttcttctgaataacgggtgtcgatagctggtttgaatatctcaacacgttgtttcgcgaatttcgctctcttcattctgcgaatcaattcctctgtctttccggagaacatagaaccgcagattacttcgattcggcctcttcttctagtctcctgtatgtggtcttctgaaaataataccatgagattttgtgttttcttgattaaataaatatgtggacaaaggtaagcaattcaatgtgcaagaactgttaaattatccattattttaagttattgcataaattattcctacattcgcaccgtataaacaatggactgacatgaaacagaagctattaacagatattgagttggatgttcatgagttgaagtatctcatggattcatttaccaaggagccgactccgactttgtctgaactgttgaagcggagcattacacggatgcagggacgtttggatgaactgcagcaggaggtggatgctgttcaggtaatttctccgtcagctgtggaagagacagcggaagaggaggatgaagttgccgggtctgaagaagattcccccgttattatacaatctctcgaatcggttgacgtgaaagaagacgaggagggggagactattgttgcggaagagaaacctgtagtaatagcagaagaggagcctgcaatggtggaggaacctgtcgttgaaactgttgtgaaagaggaagaatctaaatcggctgtgttgggagaaagtctcaaactgtctgccggcttgcgacattctatcagtttgaatgattctttccgtttttctcgtgaactgttcggaggcgacactgatttaatgaatcgggttatcgaacagatatcagtaatgagttcctacaagactgcagtcgcatttctgtcctcgaaagtcgaattgaatgaagaaaaagaggcggtgaacgactttctggagctgctaaagaaatattttaatcaatcagcataaaacaaaaacagatgggaaagctatatgtggtgcctacgccggtagggaatctggaggacatgacttttcgggctatcaaagttctgaaagaggtcgatctgattttggcggaggatacacgtacttccggtatcttgctgaaacactttgaaataaagaatgcaatgcaatcccaccacaaatttaatgaacataaaacggtggaaagtgttgttaatagaataaaggcaggtgaaacggtggcactaatttcggatgccggaacgcctggaatttccgatcccggatttctggttgttcgtgaatgtgtgcgcaacggtattgaagtgcagtgcttgccgggagcaaccgcttttgttccggcactcgttgcatcgggattgccgaacgagaagttctgcttcgagggatttctcccccagaagaaaggacggcagacacgactgaagacattggcggaagaacaccgcacgatggtgttttatgaatcaccccaccgtctgttgaagacgttaacacagtttgccgaatatttcggcgctgaacgtcaggcaaccgtgtcgcgtgaaatatccaaactccacgaagaaacagttcggggcagtttggatgaattgatagaacactttaccgctaccgaaccccggggcgagattgtgatagtattagcaggaatagatgattaaataacttcattaaaaaacgtaaaacgtaaacgtatgaaaaagttagctgttttatttgtatgcgcagccatgttggcttcgtgtgatggctttaaaggtggaagtaaagacctgaaagctgaaaatgattctcttttgatggaactgaaccagcgcaacgctgaactggatgatatgatggggactttcaatgaagttcaggaaggtttccgtaagatcaatgctgctgaaagccgtgttgacttgcagcgtggaaccatcactgaaaactctgccagtgccaagcaacagattgcttctgacatcgaattcatctccaaacaaatggaagaaaacaaagcgcagattgcaaagttacaggcacagttgaagaacagcaattacaattctactcaactgaaaaaagctgttgaggcattgactgctgaattgaacgctaaacaacagcgtatcgaagaactgcaaactgaactggcttccaagaatatccgtattcaggaattggatgctgctgtcagcgatttgtctgtagcaaaagaaactttgactgcagaaaacgaagcgaaagctaaaaccgttgctgaacaggaaaagagtctgaatgctgcctggttcgtattcggtactaaatctgaattgaaagctcaaaagattcttcagagcggagacgtgttgaagagcgctgatttcaacaaggattatttcactcaaatcgatatccgtacaaccaaagaaatcaagttgtactctaaacgtgctgagttactgactactcatccgtccggttcttatgaattggtaaaagatgacaaaggccagttgacattgaagattactaatcctactgaattctggagtgtatccagatacttggttattcaagtaaaataaggtagacatccctttttgaattgccaatgtgctgattcctggattcaagaaattagcacattggcttttttgtttcttattatacgcataactactgatgaaatataaaaatcttttttttgatcttgatgataccatctgggctttctctcaaaatgcccgtgatacttttgaagaagtatatcagaaatattcattcgaccgttattttgattcgttcgatcattattataccctttatcagcaaagaaataccgaactttggattgagtacggcgaaggaaaaataacgaaagatgaattgaaccgtcaacgtttcttttatcctttacaggctgtgggagtggaagatgaagcgcttgccgaacagttctcgaaagattttttcgcgattattcccactaaaagtactttgatgcctcatgcaaaggaggtattggaatatcttgctcctaaatataacctctatatcctttccaatggattccgtgaattgcaatcatgcaagatgcggtcggcaggagtggacgggtatttcaaaaaagtgattctttcggaagatctcggagtgttgaagccttggccggcaatatttaattttgccttgtctgccactcaatccgaattgcgcgaatccttgatgattggtgacagttgggaagcggatataaccggagcgcacggagtagggatgcatcaggctttttacaatgtgacggaacggactactttcccttttcttcccacttatcacatacattccttgaaagaattaatggatttattataggttttctggattaagtcgtatttttgttgcgttttaattttgcataaaatacgatataatcatggatagtacgcttctgccttttgccttactttgtttcacttcattctttacattgaccaacccattgggaacgatgcctgtcttccttaccatgactcatggtatgacggataaggaacgtcagtctatcgtacgtcgcgccaccattgtgtcgtttattacaataatggtatttgtctttgccgggcagtttctttttaagtttttcggtatttctaccaatggcttccgtattgccggtggggtgattatcttcaagatcggctttgatatgcttcaagcccgttatacaccaatgaaactgaaagatgaagaaatcaaaacgtatgcggatgatatctccattactcctctcggcattcctatgttatgcggtcccggagcgattgccaatgctattgtcttgatgcaggatgcacattcttatgaaatgaagggaattttgatcggcactattgccctgatttatctgctgactttctttattcttcgtgcttctacgaaattggtaaacgtattgggcgagacgggaaacaatgtaatgatgcgcctcatgggattgattctgatggtaattgcggtggaatgtttcgtcagcggattgaaaccgattttggtggatattgtgagagaggggatgcttccttgatgataaaagatagaagggttgaagagtccttaaaatgaaatttatctttgctgtaaaaaatgaactacccttatagaagttaataagatatatataaataaagccgtaaatggatgacaactatcaggaatattttattttaaattacttttgtaaaaaatagattcccgagtttttttataacccccttaatagaaatgagactaaaactccaaggcttgccaaagagtttagtctcatttttacctttataaatcagtatcttttttatatcttggaattggatatattgtatctactcttttttatttcattaaaaagaagtgaattgtttatggattctgatcagtggcaatatttaagctttcattaccgtcgaactctgtcattggaatcatcatcgtcatttcccagtcttccggatcaatataacgtctgtagtctaatagacgtgctccttctccccattattcgatacgatgttgaagtaaatgtttcttacgtaaaactatttatgtatatatttataaataataagacctgcaatttcgattaattctaaaattgcaggtctcatctacttatttaaaacttatccttatatggaggcaatattaaaaaatgttttatcgaggtagattatcactccatccctctgtttgtataactccaaaacctgaattaacttcaaaagaaggtattgggtacacaaatttggcaatgttgaaattagtatacgctccatctgccacactaataattttgcctaatcttcttgcatcaaagaagcgatgtccttcttgaaccagttctaattttctttctttgtcaatcacatcaataatcgtctgatcctctgcaatttcactatcatccaaatccgggtttctttttgccgctacttccaacagtttttctttagctttaccataatcaggagttgattgttttgcatatgcttctgcctgtattaaatacatttcaggcagtctgaaaaccggcaagttagaaatctgattattggttgtgataccacgcatttttccaccagtccacgtaccgccaagaagtgccagacgaatatcattagatgaatattctgctattgttgcgctgttaatagacaaaccgtatttattccataaagtattcagagcattagcagataaataatcatcttcggcttttgctataaagaaaatgtcttctgtcgaaacagccaatgtcgtgtacatattcttatagtcttctttggttgatacaattgtaccaccacttagggttattgcctcttgagccgccgtaatagccccttcgtaatttttcatatagagttttacgcgagcttcaagtgcagcaactgcagccgtattcatatactgtttacctacattttcaacaccttctttagcataatattctttagccttcgttatatcatcaagaatcaggctataattttgttctacactaactcttgacacctgtgaataggcagggacgggctcagtaacgtttacgatacctaatgtcgttttgttggcttccgaatatggcaaaccaaacatgttagtcaaatagaaagaacagagggctttaattgcataggcttgagcgatgcatccttccacttctgtcagatccccctttgttacttctttaaatgaagcaccttctttaatgatacgtgcacaacggtcgatagcccaatatccgtatgcccatatttcttctatgtatgaattagtatccagtatctgatagcggaagatgtcatagaaatgggacgttgcaacggaatgtgaagtgatatccgttggcgcatctccaattgctaatacatcacgtcccagaaaacgatatgaacctaatgtgtaatatacaccatttaaagcattctgaaaatcttgggtagtaaccaaggcttcttctgtcggaacagaagttgatggcgtttctgtcaagaagtcatcgcatgcggtgaatgaaattgccatccaaccggttaataaagcaaataatattttcttcattgtcataaatttctaaagttattttttagaagctaagattaagaccgaacatgatatttctaggtacaggatatgcccaagactgcataccggtagatctagtttgtggatcaaatcctataaaatctttagcagtgatagtgaacaaattgtcagcagagatataaactcttaaattgtcaatagccactttattcataaggttcttcggaagagtatatcctaaaaccatggatttcattctcaaataagaaccgttcattaagaaacggctggaattagtttctgctcccgagttgtctccagctacaaatttgggtacgtcggttatatctcccggcttttgccagcggttgtcataaacatagttagataccggacctaagaaataatgtccaacctgcatatcaaatgcaaatccggagttatatactttatttcccaaggtgaaactggtatcaaaagagaagtcaaaacctttgtatttgaaattcattccaaagccaccataaaatttaggatcggcagaacctacaattcgctgaccggcctcatttacattttttgttttctcatccccttcttgtcctttataccacattgcttctcctgtttcaggatccactcctgcatattccggcatatagaatgtattatacgcctcgccaacttttctgatagttagagtattctcaattggtttttctgtggcaagttttatgattttatttttatttgccgtaccagtgaaacgaacatcccaactgaaatccttatttctaagtacgttagcgttaatcaagaattctatacctttgttttccatctcacctacattttttaggatagacccgaatccagttgtgtaagaaagtggtacatcaaatatcatatcttttgtccgttggttataataatctacttcgagtgtcagtctttcaaagaaaacagcatggataccgatatcggcttttgcaacagtctcccattttagatccggattggctatttggtaaggaatagctcctggtttaccattataagaatatccataattatataatcccattgctgcataataaccaatatcctgattacctacagttccataactacctctgatagtcaaatctgtcaaccaacttttggtattttccataaagctttcgttagagatgcggtattttgctcctatagaccagaaaggagcccatttgttgtttacaccaaatcttgacgagccgtcataacggaaactgcctgacagataatatttatcattcaagttatattctgcattcataaagaacgaagaaagagtgcttgctttggttgaagatcccgcccctgttggcttggaagcattgtccaattcaaaaacagcatcactaggatatccactggcagctgcataaattgttctataagatattttctgtgcttcttgtcccaacaatacattcaaatgatgcatgtctttgaaagtgcggttgaagtttacggtattggtaatggtcaaggttgttgccctttcctgatttctttgaccaagcataccgctaccggaatattgaggattataaattgaactgtaaaagaactcgtccaagtcaattaagctcaatcctgcatttgtcttccatgttaagccatcaataatattataagtaaaatatggattcacaaccaatgtaatctgcttttgattacgtttatcacctttttctttatcgttaatggctacaggattataattaacatttgtattatatgttccatcttcattgcgcacctgttcaaacggacggatgtcatatactgctacaataggattagtatattggctttcagtcatagtattgtttatatcggagagtgctccattcacagaaagtccatatcctatccgcccgctttttccatctaaactaatacgtccgctatagcgtttcattccagttccgatgacgatacctgtattctgaaaatatcctccactaatataatagcgcaaattttcattcccaccttgagcactgatatcatattcttgtgaaaaaccattttgcagaatctccttcagccaatccacactcttgatattttgcgtcaagtccacattataccaatccataacataggcattcagccattcagcagaagtcatgccatcctcaccgtcatatcctgcatttgttagtccttcggtccagatctctttgtatttatccagatttgtcgtacgataattatgatctatcttacctacaaaactagttccgacttttgcattcacattaaaacgcgcttttcccagactaccttttttagtagtaactacaattactccattcgctgcacgagctccataaatagctgtagctgtagcatctttcaaaactgtgatggactcaatgtcgttaggattgatattagccatcggacttgccgccatatcccctgtcccggctttgttataagcccccattttgtctgtgtaaatggcaataccatcaattacgtataaaggttcggttccagaattcattgaaccaactccacgaatagtagtagaagcgtatgcaccaggttgtccagtcaagctatttacttgtaaaccagctactgatccttccaaagacttcataaagtttgcatctgtttttttcatcaagtccttattatccaccgtttgggcagatcccgtaaatgccgcttttttagttaccccatatccggttaccacaacctcatctattagctgtgcatcagatttgagaaccactcgcaaattgggctttatcgccacttcctgcgtctgcataccgatgtacgaaatctgcaaagtctttgcagaactaaatacaactataatatgttgattactaacaatatatatgatgtttgctttcctttggaaatatttttctgttgtagttattatacagattatcaatatattaagcacctaccaaacatattagtttactgatttatgataccagatttctatcaaaaatagggcataaccatctattaattaattatttaagttcttatcttatatgatataagctaaaacttatttccatcttaactgttgaagatggttttcttgttctaaattatatccaataattattgactataataatatattcattagcaaacggtaatctaagaaaaagaaaaactccagatgaaaaaatgcatattttattactgtatattttaaaatatgcaggggtggattcaaatatcctccaaaatcgcagagaatatgattgatgaatatttatattggatggttatatgctttttctgtatcaaagagattgtgtaattacatctaattatgcaaaaagaggtatttatcatttatctgatgctaaaatgaaagaaccccaaatgccggattttaatagctattagaggctgtcaagtttataaattagcttttaatcctttccttttaaagaaagcaagggcttctctacgaccaatgactcgttccttttaaaggaacgctttattcctttaaatgggacgagtgataatattcgtaattatgatgtatctttagattatatatatgcgttttcggaacttatattgcatattctttcatttaattatacacactttcttctattagagaaaattataccttccatttctataaccaaatcttaaaaacagaacactttcgtttagtttttgtgcttattattatttttttgatgaggcagttttctcaagatcacgcaccactgtaatatccattatattcgcatatacctgcgtggtctttacacttttatgtcctaacagtttttgtacagtagttatattggcaccattatataataataaggtagcatttgtatgacgggcggtgtgaaacgatacacgtttatcaattttagccaagcctgccaatatgtttaattccttattaatattagaattgtctttcaacttgaaaaaactattgaagtcatctttatagcgttgcaatatctggattcctttaccctcaaataataaatataaaggaaggcgtacctccatacctgttttgacagatttgtatattatccaagtctcctgatggaactcaacaatatttgcagaggtcagattagtgaaatcagaatatcgtaatccagcataacagcaaaataaaaaagcatcttttgttttttgcagtctcgtatatcttccagtcagctgcaaattctcaaatttgtgtaactcttccggagctaagtgtgtatggcttccttctatacttttaattttatattttctaaaggcatacttctgtatatccatatactccttatttattgcaacattaatatatcgtttcagatgcttcatgtgcttggcaatagtattaaggtgataacctttagattgcagataattatcaaatgaagacacaaactcaaatgtcaaatcggtaaataatacctctttcttgaactcctgaagtaattcaagcgtggaaaggtgattttgacgggtactttctttcaaagaagaattggctatctcctctttaaaaaaagtcaaaaacgaccttccattgcttagaggtttatcaatagaattttttaataaatctaacgatatggactttccctgttgccatagtccaagttctgtttgctcaatagctgctatattttcatataacatacgattcaaaacattcgcattaggatgattcttcaccatttttcgtttggcatcccactgttccggtttgagatatattttggtggagaaatacatctttttcctgttcagataggcttctacctgaactaatgccattcctcttttattcaatctcttctttctgttaaacacaaggttgtaactgatcttttccatactttcattttttaattaataatagaacaaattagacgtaattctgtgctatatcagaggcgaataagcattaatatctctaaaaaataaatcttcaaatcacttggtattcacaaaactttaaattaaatgccacttttttattcgctttttcacgaaaaaagcaaaaagaatggcttttaaaggtgttttatgactaaaaacgagtaaaagaaatattaaaagaggcattttgcttatgcaaagtgtcaattgctgttttagcaatcaaagcttttggttgaaaaaaatatgcttatcggcataaatacagcttgtaaaataacaaaatgttatatttgcaacctttttttattaatataattgctagtttcagttttattaatatatttgcaaattgttagagtaaagatacaaataatgtaaagttaaactttaagagagaatttatgaaaagaaaattaatgctgttattggcatgcctttttgtgggcataggcctagtaactgcccagactcaaaaggtcacaggcgttgtgatttctgaagaagacgggcagccagttgttggcgcttctgtgttggtaaaaggtaccactctgggtacaatcacagatgtagatggtaattttaatttgtcgaatgtaccaagttctgcaaagactttgcagatttcgtatattggtatgcagacacaagaagtggtgatcaaaccaactttaaaagttgtgctaaagtctgattcccaaaatctagatgaggttgtagtgacagctatggggattaagcgatcggaaaaatccctaggttatgccgtatctagtgtgaagggagatgaaataactaaagcacgtgaaagtaatgtacttaattcattgtctggtaagattgcgggactgcaaatagcccaatcatctggtacggtaggtggtagttcaagtatacagattcgtggagcttcgtctattggtaccgtttcttctcctttatttattattgacgggcttccaattgacaatggttcctataaccctgacagaactaatggtatagttgatgtcggtaatcgtgcaggggatattaattcagatgatattgaatctatcaatgtattgaagggagcagctgcaacagcattgtatggagcgcgtgcaaaggatggtgctatcgttattactactaagaagggaaagaagaactcaccggtgtttgtaacagtaaactcttctacacgatttgaaaatgtactaaagttacctgactttcaaaatgaatatgcacaaggcagttatggtgtatataatgtgaaaatgttgaatggttggggaccgaagatctcatcggtacaagatcagcagtttacagattacaaaggtgataaagtgactttgaaggcaaatcctgataatgtaaaggatttctatgaaacgggaatgagttatattaataatgtatcagttgcggggggtggtgaaaaggcggacttccgtttgagctttacttctactaatcagactggtgttgtacctggatctgactataataaatacgctttttctgtcaatgcgggtatgaattttactaagaacttcacaggtcgtatttctgctcaatatatacgttccgactctgaaggtcgtccagcgcaaggtgcaaatgatagtaacctactgattccattgattaatggattgccgagaactattgatatacatgatattcaaaagaattgggtggatgagaatggaaagcaaatcacattagatccggaaggtaaaagtaataatccatattggattattaataagaataagtttaccaataatttagatcgtatgattggtaatatcacattgacttataaaccgattgaaggactgactatcaccaataatgccggaacagatttttacacagaaggaaggcgtaaggtatatgcaaaaggtactgtaggagccttgaacggaaagttccagacttggaatttgtataaaagaattataaataatgacttaatggtttcttacgagaagacttttgcaaatgactatcattttaaggtaatgatggggcataatctctatcaggaggaatggaagaatgaaaatgtgcaggcgcagaatctggttgttgatgggctatacacatatactaatgcgaagtctactactccggtaaattattatgaaaagaaacgtcttgttggtttatatggagatattagtttgggatacaaagatatgcttttcgtaaatgtaacaggacgtaatgactggtcgtctactctaccgatcaataatcgttcctatttctatccttccataagtggtagttttatttttacggagttgatggaaaacaaagatattctgaattttggtaaggttcgtttgagttatgctaatgtgggtagtgatgaagatccgtacaatttggcatttaaatatactcccgctagtacttactttttgcaatatctgggtaatgttaacactttcccccatatgggattagttggctttacgggacctcgtgtcttaccaaatgagaatttgaagccgcaaaatcaaagttcttttgaagttggagctgatttgcgtttcttcggtggaaaaattaggttagatatgacttattatagcaatattacaaagaatcagattgtaagtattgatgtcccattgtcaacaggctactttgccaataatattaatgccgggaagattgccaataaaggtgttgaagtaactttggggttgactcctgtggaaacacgtgattttaaatgggacctggatgcaacatttgcttcaaataagcagacagtggaggagttagctgaaggacttgatgaatatacgttaacgagtggactgagcggtttacaaattaaggctgctaaaggagattcgtttggcttgtatggcacgggttggaaacgtgatgaccaaggaaattatgtgattaattctaaaacaggtttgagagaaactgttaataacgtgcgtttaggagatgtatatcctgattttacgatgggaatcaacaatacatttacttataagggagttaccttgagtttcttgattgatatccgtcatggaggttctttgtattcagagactgtagctaatttaagaagtagcggtttggctgctgaaacaatagctcaccgtgaagatgcttcctttattgagccgggtgtaatccttcaggatgatggaacatatagacctaatgatgttcctgtgaaaagtatgcaggattattggcagcatatatccaattctagtaataatgaagggaatatctataatgcatcatttgtaaaactcagagaggtacagttgtcttatagcttcccacgcaaatggttcaagagcttttttgttaaatcattggatttaggttttgaggcacgtaacttatggattattaaagatcatgtgccacatattgatccggaagctaacttcttcggtccttctcagattgggggtggtgtagagtttaacagcataccttctaccagaagttttggatttaatgtcagattaacattgtaagatttaaacgaatatgataatgaaaaagaaaatattaacatacgcattgagcgctttggcatgtttaacttcatgtagcgattggctcgatattaaccatgatcccaatactgccgagaaagttgatcccgggtatttgtttaactatgtagctgtaaactgggctggaacacgcactggtggtgacttttatattcctttatctatgagttcgcagtgtcaagttgatggtggacttgattacggtggctgggatgaatctgtatatactatttctccttatagtacagggaatgtctggaaacattattattctgtaggtggcaataatttgatgttagctattaaaaatgcagaagagtcagaaccggtgaatcacaatgctattgcgcagtgtaagattcttttggctgagcatatgtatgaggcaacgatgttgtggggagatattcctttcacagaatcctggaacggaacaattaaatatccgaaatttgattctcaggaaagtgtattgaatggtgttttgtcattacttgatgaggcattacagcttatagatctgaatgatgctaatgcaattgatgagtacgatatctattacaaaggtgatatgaacaaatggatgactttggcaaagtctttaaaattcagaacattgatggttatggtagataaagacccttctaaggctgctgctattggtacgttgctgcaggctggaggaatggttgcatcagcagcggacaatttggtatttccttactctacagatccgggtaaccagaaccctaaatatgaacttatagaattggttggggggacacaaatattgttctttgccagcaattatatgttgaaaccgatgcaagaacgtaatgatccccgtattccctgttattttgaaccgggtgcggatggtgtataccgggggttgggtaatagagaggctgcaaagacggatgatgaagaaaatctactgtcatctgttgtaagcaactaccttttcagaagagacgctccggaattgatttattcttgtcaagaacagctacttttggaagcagaagcttatgcgcgcggattaggagttgctcaaaatctgtcgaaagctaatgaactgtacctgaaaggaattcgtgaagcatgtgctttttatggagttgcggaatccgatattgatacatatgttacaggtttaccggaattgacaacgatgacccaggaaaaagctctgtatgagattcatatgcagcaatggattgatttgatggatcgtccgtttgaggagtttgtacaatggaggcgatctggtactgccggaaacgaggtcccgacattgcaagtcccggaagatgcaacttcaaaagaattgatcagaagatgggaatatagtcctgaagaaatgacagctaatattaatgcaccgaaagaatctccgaaaatctgggaaaaactatggtttgatttataattgaattaccataaatgatacgaaaaagaggacaataaaacattgtcctctttttttttgttatatttgcgcccacattattatatataatagaagtaaagaatgaaagaatttgtaatatccgaagccaaagtagaaacagcagtgcttgtaggactcatcacacagacgcaggatgagcgtaaaacaaacgagtatctggatgaactggctttccttgccgagacggctggggcggaagttgtgaaacgatttacacagaagttgccgacggctaactctgtgacttatgttggaaaaggaaagttggaagaaatcagacaatatatccatgacgaagaggaagcagaacgtgaagtaggaatggtcatctttgatgatgagctttctgcgaaacagattcgtaatattgaagctgaactgaaagtgaagatactggaccgtacttcactgattcttgatatatttgccatgcgtgcgcagacagccaatgcgaagacacaggtagaactggcacagtataaatatatgttgccgcgtttgcagcggctttggactcacttggaacgccagggaggtggttccggtgccggtggtggcaaaggttccgtgggacttcgtggtccgggtgaaacacagcttgagatggaccgccgtatcatcctgaaccgtatgtcattgctgaaagaacgtctggcggagattgacaagcagaaagctacccaacgcaagaatcgcggacgcatgatacgtgttgcactggttggttataccaatgtgggaaaatcaaccatgatgaatcttctctccaagagtgaagtgtttgcggaaaacaaactgttcgctactttagacactactgtgcgcaaagtgattatcgataatctaccgttcctgttgtcagatacagtagggtttattcgcaagttacctaccgacttggtagaatcttttaaatctaccctggatgaggtacgtgaagcagatttgcttgtgcacgtagtcgatatttcccaccccggatttgaggaacagattgaggtggtgaacaagaccctggcagagattggaggcagtggcaaacctatgatacttgtatttaataaaatagacgcttacacctacgtggagaaagcgccggacgaccttaccccccgaacaaaggaaaacttaacactcgaagaactgatgaagacgtggatggcaaaaatggaggataactgcctctttatttccgcccgcgaacgaatcaatatagacgaactgaaaaatgtagtttatcagcgagtgaaagaattacacgttcagaaatatccctataacgattttctttatcagacctacgaagaagaggaagaataatcaatatgctaatgtgctgatgtgccaattggttgcgcatactgcatcagaattggcacattggcatatgggcacattaacacattattaagatgaaagactatcgtagattgactgaagatgagatacttcagttgaagagccagtcatgtctggccgatgattggggaaatgtatcagtggcagagggttttaattgtgagtacgtccatcatacccgtttctcgggtgaagtaaaactgggggtattcgaagctgaatttacattgccggggggaatcaagaaacattcgggattacgtcatgtgacgttgcacaatgtgtcggtgggcgataactgctgtattgagaatatacagaactatattgctaattatgagattggcagtgacaccttcattgagaatgtagatattattttagtggataggttaagcacttttggtaatggggtagaagtggctgtcttgaatgaaacaggaggccgtgaggtgttgatgaacgataaattgtctgcgcaccaggcatatattcttgcactgtaccgccatcgtcccgagctgataaaccgtatgaaatctattgcggattattattccaataaacatgcttctgctgtcggcagtattggcaatcatgtgatgattctcaatacgggctcgatcaagaatgtccggattggtgattactgccatatctgtgggacctgccgcttatccaatggcagcgtcaatagtaatgtgacggcacctgtacatatcggacatggtgtaatctgtgatgactttatcatctcttccggctctaaagtggatgacggcacgatgttgactcgttgtttcgtcggacaatcctgtaaactgggacacaattattccgcttccgattctttattcttcagtaattgtcagggagagaacggtgaggcatgtgctatttttgcaggtcctttcactgtgacacaccataaatctactttattgattgccggtatgttctcgtttatgaatgcgggttcggggtccaatcagagtaatcacatgtataagttaggtcctatccatcagggaacgatggagagaggagcgaagaccacttccgattcatatatcctgtggccggcacgtgtcggggctttctctttggtaatgggacgtcatgttaatcatgccgatacttccaatcttcctttctcttacctgatagagcagcggaataccacttatctggttccgggagttaatttgagaagtgtaggtactatccgtgacgcacagaaatggccaaagcgtgataagcgaaaagatccgaaccggctggattatatcaattataacctgctgagtccttataccattcagaagatgtttaaaggacgttccattttgaaagaattgaaacgtgtatccggtgaaacttcagagatctactcctaccagagtgctaaaatcaagaactcttctctgaataacggaattcgtttttatgaaatcgccattcacaagttcttgggaaactccatcataaaacgattggagggtattaatttccagaccaatgaagaaatccgtcagcgactgaaacctgacacggaaatcggacttggcgaatgggtggatgtttccggactgattgctcccaagagtgaaatcgaccgattgttggatggtattgagaatggaacagtcaatcgtttgaaatccatcaatgcaagctttgcagaaatgcacgagaattattatacctatgaatggacatgggcttatcataagattcaggaattctacggcctgaatccggaaacgattacagcacaagatatcatcggtatcgtgaaagcgtggcagcaagctgttgtcggattggataagatggtatatgaggatgccaagaaagaattttcgttgtcttccatgaccggatttggtgctgacggctcccacgacgaaatgaagcaggattttgagcaagtacgcggtgatttcgaaagtaatacctttgtgactgccgtcttgaaacatattgaagataaaacagctcttggaaacgagttaatcaaacggattgaagcaatcgaatcataataggagtggcagatggcgaactgtggatgataaacaggatatgataaatagcaaactgtaaataaaatagtgagcggtgaacggcagatgtcaatgaatggcatagcttgtttaccgctcgttgtttattgtttatgattgtcttttgctgttcctgcttttctccgttattcattcttaattcttcattcatcattcgccattcttcattcttaattactacctttgccacactaactaacattacgtaataaaataagaaacttatggcaacacctccgtttaagtatcagcccatgtttgaaaagggaaaagatacaactgagtattatctgcttacaaaagactatgtatcagtaagcgagtttgaaggaaatcctatcctgaaaattgagaaagaaggtttgactgcgatggctaatgcagcttttcgtgatgtatcattcatgcttcgtcgttcgcacaacgaacaagttgctaagattctgagtgatccggaagcaagtgaaaacgataagtatgtggcattgactttcctgcgtaacgcggaagttgcttcaaaaggtgtacttcctttctgtcaggacactggtactgctattatccatggtgaaaaaggacagcaggtatggactggatattctgatgaagaagcgctttcactgggcgtatataaaacatacactgaagagaacctgcgttattcacagaatgcgcctttgaatatgtatgatgaggtaaatacaaaatgtaacctccctgcacagattgacatcgaagctaccgaaggtatggaatacgaattcctttgcgtaacaaaaggtggtggttctgccaacaagacatatttgtatcaggaaacaaaagcgatcctgaatcccggtacactggttccattcctggttgaaaaaatgaaaacattgggaacagccgcttgccctccttatcatatcgctttcgtgatcggtggaacttctgctgaaaagaacttattgacagtgaagctggcttctactcatttctatgataacttgccgactactggaaacgaatatggccgtgcattccgcgacatcgaactggaaaaagaagttttggcagaagctcacaaaattggattgggcgcgcaattcggaggtaaatatcttgctcatgacgtacgcatcatccgtttgcctcgtcacggtgcttcttgtccggtaggcttgggagtatcttgctctgccgaccgtaacatcaaatgtaaaatcaataaggaaggtatctggattgagaaactggattcaaatccgggcgaacttattcctgtagaactgcgtcaagcaggtgaaggtgatgttgtaaagatcgacctgaaccgtccgatgcctgaaatcctgaaagagctgactaaatatccggtagctactcgtctgtcattgaacggaacgatcatcgtaggtcgtgacatcgcccatgctaaactgaaagaacgtttggatcgcggcgaagacttgccacaatatattaaggatcatcctatttattatgcaggtccggcaaaaactccggaaggcatggcttgtggttctatgggtcctactacagcaggacgtatggactcttatgtagaactgttccaaagtcatggcggcagcatggtcatgttggcaaaaggtaaccgtagccagcaagtgacagatgcttgtaagaaatatggtggtttctatcttggctctatcggaggtccggcagctatccttgcacagaataacatcaagagcatcgaatgtgtggaatatccggaattgggtatggaagccatctggaaaattgaagtagaaaacttccctgcatttatcttggtggatgataagggtaatgacttcttcaaacagttgaaaccgtggaattgcacaaaataaccggttttaacctgttgggataaaactttaagaagaggctaaatgccctgaatttataaaatcccctcactctgcaatgtagtgaggggatttcatcttttgaggacttaaagactttccggatatttatttttgtagtgtagatatcagcctttcatcatttgtgattacttgttctgttcttttttccatttttcatatctcttcaataccttactaccatctttgttataccaactataaccattccggcgctcatgcccgatttccgatatatcatattttttaatgccgtcacggtcgcagaaaaaaggccgattcgtttccagttcataaaaacgtgcccagagagttggacagtcttcacagggaaccatacgatagtcttttttaccttcaccgttagtgaaatattccttctgtattccttttattttagacttttggaaccatttgattgctccttctatggattttacaatgtctgtggatggattaggaagtgacatcaacagcaatacaatattgtccgactcttgtccgcttagtgacggaagttcataagcacgtgctttgcagggttccaaagtgacacggtcgtgttgggcgcaccatactgttaattcaccattttggcacacctgcgttttgagtatacactctatacctttgttgaatgcattgcgtgcttgttcgcagatattgtcaggaagaaaagtatatggagctttcttttcgtatatgctccgaagttgattcatgactcttaccattgcattgtcattgtaggtgatttgtacataataacctttgggacgtggataaaattgaggccatcctccgttttcatactgcgatttgagcagatattgaataccgttcagcactccttctttatatttctctttctgtgtagccagataaagtcgtgccagatattctatttctgtcgtggtggcattgttgtcgattgtgctttggttgatatcctctttggcttttagtgccgctttatattcctgttctgtcagttctgccggcatatagatattttttggccatcctccggtgatttgctgatacagtaacacgttgtcaccaatgcgttgggcttcttccgtcttgaagaaatcgtcgtcaaatttaggagcgatgtgtacccattctttgtaattttgttgttttctgtagtctgttgctttttgggctgaggcgtttgtcaggataaaaagtagcagtaagaaaaaacctggttttctcatggctttattatttaatgtttttatagtatgcaaatgtatgaagaaagaaaaatactgatatgtaataactgttttttatagagtaaaaattgggttaaccctcccgataagaagattaacccaatcaaaaaataaatggaaactacttccttattccagatatttcgtaatctttccgctgatttgtaacagggatatttcgcaaagtttcgtattatattcagcagagaggatgcgttcctctgcatctaacaaacttttttgtgtttcacgcacttcaaaaccggagaggtctccctgtatataacggtccatggcaatatcgtgattatctttggcggttatcaggttttgacgttccagattcagcaattgaagattgttgcgataggcttgccataggttactgagatcagagcgaagtgctaattccaagtcctgtcgttccaggcgacgattcttgaaagccagacttgcatttctcttttcgcggcgacgattaccgtcgaagatattaaaaccgacagttattccggcattgaagcccagttcacctcttctgctgtttgcattgatgtcatacttgttgaacgtatatccatatccggtatttaatttgagatatggatagttgcgtgagtttattttcttgtagtccaattgggcaagtactgtgttttgatcggccttgagcaaagaagcattggttgctaacgtagaattccacaaatcatcaaattgcaagtcgctgtgtacgtcgatagtggagtctttgataataatgttttgattgacattgttgttagccatcagttcattcaactggatgcgtgaagaatgtagcaattcctgttgtttgatgtattgggcactgtctgcattgaaatccacctttgcctgctgataatccagccctgaaaacttaccgaccaggtgactagcctcggctatgcgcaagcgctctttggaaagtgacattgcataatgaaagtttttcagacgaatcttctgctggataaaattatagtattcggaagtcagggcagcgataaaatcttcaatggcaatacgcgtgttggtttccccctgacgttccagctctttcaactgtttgtaggtggtactgatattgaatccgtcgaaaatagtccagttgaggttaagaccgacattaactgtctgatcgtagactccgttgttctttgttatttctccggtagcacgcgccttggtctcaatattgtccaggtttccggtatatccggcagagaagtccagtgtaggcaggtaacctgcatttcccaacgttgcgttgtttttgctgatctgctcttcgttatggatgatacgtaaagagtaattgttttgcaatccttcttccagacactccttgagagtgagaacttgtgcctttgcaaaagagactgataagaaggcacatgcaatggtgatataaatgatgcgtttcatgcaaattcctttctgtttcattcttgtagttttttgattcggttagtcgaaatgtaactgtaaatagccggtacaatgtacatcgtaagcagagtggatacgaccataccacccactaccgccgtacccatggcaatacgctggttacaaccttctccggtggcaaatgccagcgggataagtcccaaaaccgtagaggcacttgtcatcagaatcggacggaggcgttgaagggcagcatctttgatggcgctcattttatcctctccggcttcctgtttctgattggcaaattctacaataagaataccgttcttcgccaccagaccgatcagcatgataataccgatctgactgaaaatattcatcgtaatatctccgaaatacatgaagaccaaagctccggcaatagccagcggcactgtcaacatgataatcaatggatctttgaaactttcaaactgggctgccagaatcaggtaaatcaaaaggatagccaggataaaggcgaacatcagactggaagaactttcacgatattccttcgagtctcccgacagggcagtacggaaagtgtcatccaatgtttctttggcaatcttatccatttcatccaagccttgcccgattgttttgccgtctgccaatcccgcagagatggtagctgacacaaaacgattataacgatacaactttggaggtgcaataccgctttccaattcaatcaagttgtccagctgaatcatatccccgctactgctacggacgtaaatagctttcaggtcggccggtttatttcgttgctggcggttgatttcaccaagaatttcgtattgtttaccgttcatatagaaatatcccatacgctgtccacttaatccatattgcagcgtttgagcaatgtttttggtacttacccccataatactggccttgtcacggttgatctgaatacgagcttccggtttactgaacttcaaatcaacgtccgccatctggaaaacaggattctcatatactttagccataaacttgggcaacacttcttccagcttttccaaattggtagcctgaagtacatattgtacaggcatgcttccacgacgtccgccgaaagaagactgctgctgtacgaatgaacgcgccattgttttcttctgtaccgcttttgatattttctctgccacatccatctgggtataattacgttcattcatatccttcagcgtgatgcgcacgtttccgctaccgctggatacacgggcagttacagcctctgcatcaggcagaatggagtctaccagttgattgatgtcttctgtgtaatccctgatatattcataggtgacgccttccgctcctcgtgtattgatactgatttgcgaacggtcttcaagtggggccatttccgcaggaactgcattccatagaataccaatcaggcaaatggtgatgaaagtaaatggaagagcgatccagcgtttgctaagaaaagcggcaagcgaacggctgtatagccgattcattccttcaaagaacggttctgtttttgcatagaaccaactttgtttttctcgtttaatgagtaacttcgttgccaacatcggagtgaaagtcaatgcggcaaatgaggatataatcaccgaacccgaaattacgatactgaactcacggaataatcgtcccgtcattccatccataaagacgatagggaagaataccgctaccagcgtaatagtggtggaaataacggcaaagaaaatttctttggctccttctattcccgcttctttcggggccattcctttctctatacggatgtagatattctctgtcataacgatggcgtcatctaccaccagtcccaccgatagtacgatggcgagcatggaaagcacattgatggagaatcctgccagatacatgacgaagaatgcaccgatgagggagacaggaattacgatacaaggcaccaatgtaacgcgccagtcacgcaggaagaggaagataatgatgattacgagtacaaaagcctcatacactgttgactttacctcattgatagacgcacggataaacttggtattatcaaaaccgtagttatagtgtacgtcttccggcaagtcctttttcatctgctccatacgctggtataccgcatccgcaatctcaatatggttggctcccggctgtggaatgactacgacacccaccataggaacgccgttcatcttcatataactcttaatatcagccggccccagttcagcacgtccgatatcactgaatcgtacaatacggttattctcttctttgacaatcaagtcattgaattcatctgcggtatgcatcaatcctagtgtacggatcgtcaactcggtggtatttccttcgatactacctgaaggaagttccacattttcgttatctacagcgtttttaacatcgacgggagtgataccgtaacctgccatctttaccgggtcgagccaaaggcgcatggagtaacgcttctctccccagatagatacactacttacatcagaaatagtctgtaattgttctttcacagtcagatccgctatttcacttaattccaacagagaacgtttgtcactctgaagagcaaccatcaagataggcatggcatcggcatctgcttttgaaactgtcggtgggtcacagtcgcgaggcagataacgttgggcacgtgaaaccttgtcacgtacgtcgttggccgctgtttccagatcgacggacaattcaaattctactgtaatacggctttgcccctgttggctcacactggacaaagaacggataccgggaataccgttgatattctgttccaacggttcagttatctggttttcgataacgtcggcattagctcccggataagagcagctgacagaaataatcggattatctaccgacggatattcgcggacacccaaatagttgtatccgatgaatccgaaaaggaggataataatcgttaatactgtggctaataccgggcgacgtatacttaattcggagatgttcattgatttatgatttctgatttctgaattatgatttctgagttatggattgaagatttctgatttttgaattatgatttctgatttctgaatgtttgctgtattttgctgacttataaatcataaattatttggcttataaatcataaatcagaattcataaatcataaattctcattcttcaatattgtcaagtgttacggcgagtccggtacggagttgcaatgttcctgaagtgatgattgtgtctcctacgtgcaatcctctaatcacttgcacttcagatgcggtgcggataccagtaatgatatccaccggttcggcctttcctgatttatacagatagactttatctttacccatttccggcacaattgcttccgttgggatggctattgcattaggtatttcatcctttttcaacagtacactggcataacggccgggaagtagggtgcgattgacattcgggtataatgcacgggcggtaaattgatgcagattcggatcgatggcagattctacagcgtatacctgtgcgccaaaagcatccaatgttccttcaacgctgaaattgagattggtaccctttttgatttgcttggcataacgttccggaacggaaaattcaaccttcagtggagcgatttttgtcagcttggcaacgactgtggtcggagacgcatacgtaccgatactgacttggcgaagtccgatcactccgtcaaacggagcacgtagctctgtcagttcaatattagctttgataatttctatatcggcattcagagttgctaaatccgttttcacctgttcgtaggcttctttactgacagcatcccgtttcaataaagcatcctggcggaatacacggtcttctgccagtttcaattgcgaaatcaacctttgcaattgtgcctgcaactgtctgtcattcactttggctagtaattggcctttctttacggctgttccttcttcaaagttgatttctacaatctttcccgacgtttcgaaagacaaatccacttcttcatcgggcagaagtacaccggtagtggtgaattcatctgtcagagattgcggttttatgaccttggcatttacatttaaaacttgtttccctctttttttattaccgcccatcactttgtcggcggctgctagttcgtcgttttttttcggtaattgtgagtagattcctccaccgataatcccggcaccaacaagaataatgatgccccatttagtcttcttattcatggtttagtattgtatatggcaattataatataatctttgaagattagactttccctgactggaaaggtttaatctgtaaatgatagaaaaaaagttaatgcatctttttcaatttaataagctcatacacttaagggaactattcttttatggcatatagaagggtggttgatatgactttcccttttttagtgatagtttctgattttaccagcccaatatttttggcataccaatctattgaatattcggtttctgaaatgaacatgacttttcctttttgttccgtgtagattttaatgcaatcaaaatctcccgcaggagtatgtatggtttcacgtcctttatattttccttttagagaagctttcatagtcattggtcctgatttttgcaagaaattacactgtggtatatcatctccattctgaacatgatcctttaaaggtatgctaattcgtccttctgcatatatgttcttagaatatttctgatattcatattctgatttaccatccaaaaggataacttcggtcatatcttgactcttatgataaatatagaataacctgttgataccactttttatacttagagaatcatagtgctctccgaaagcatcttctcttatgattaagcgatcacctttatcaaccacgtctgcgatgcacatagtatctttcagtgtttttccttcctttacttcggttgttacatagtaagcagttcttccttttttaatactgcaatattgtgcatgtgcggaaattatgtataaaatgaaacataataaaactaagatttttttcatattgtttttttgtgtgtactattataactataagtgtgaacagcattggttttataagcacgctgctcgcattttttctaataagcagcccgatattttccttcctctttatcttccaacatattgagataagaggtataacgggattcgctgatgaggtgctcttccactgctttgcgtacggcacatcccggttcatgacgatgtgtacagttgccatatttgcagtcggcggaggttttgaatatttcgggaaaataatgtccgatctcttcttcttccatatcgaatgtgccgaagcccttgatacccggagtatcgatgatatagccatctccttccacagggaacatttcggagaaagtagtagtatgcattcctttgttgtggtaagaagaaatttcgccggtcttggctgctatgcccggcagtatggaattgataagagtcgatttgccgactcccgaatgtccggaaaataaagtaatcttgccttccagtgcttttttgatttcagccactccagtgccgctctttgcggaaactttgaagcaagggtagccgatttgtgtgtataagttgataagtgcgtccagatagcggagttcatcttcgtcgtaagcatctaccttattaaataccagttttacagggacgcgataggcctctgcggatgcaagaaagcgatcaataaaaatagtggaagtttccggataattgatggttaccaccagcatacactggtcgagattggcagcaaggatatgagattgtttggaaagattggacgagcggcggatgatgtagttctttctatcttctatttcactgataaaagcagtgccttcctgattaagtataatccggacacgatcacccactgcaacaggattagtactgcgaatccccttcaaccggaaattccctttgattttacattcaatagattgtccgtcatcggttttcacctgataccaactacccgtgtttttgattactaatcctttcatataaattataaattaaaaatgaagaatgaagaattcaggctgtgtttcaactgaataatacagcattataattcctcattcttcattcttaattcttcattattttttagacggtcataatttctttatccttttcagccagcatatcatcgatttgtttgatatacttatcatggattttttgcagtttggcttccgcattcttctgctcgtcttctgccaatccgtcttttacggcctttttcagtgcgtcgatgccgtcacgacgcgcgttgcgtacgcttactttagccgtttcgccttctcctttacactgttttgccagttgtttacgacgttcttccgtcaggggagggatgccgatacggatcatttctccattgttttcgggcatgataccgaggtcagagtcgatgattgctttttcgatgacacggaacatgcttttatcccaaggcttgattacgatactgcgggcgtccggagtagtaattgctgctacattgctgataggtaccatacttccgtaagaatctacgcggataccatctaataagcgtgcactcgcttttccggcgcggatatgtgccagtgcttcttccagatacatgatggccatatccatcttttcttgtgcattgtcaaggcaagtctttacgtctaccatattttttgagatttaaaattgcattttgattgattaagtagcaaaagtatattattttttgttcatctgcaacagcatacccatcttttttatgagtgacttgccaatgataatcagggtaacggcggtgataatcattaaaatacccatcattaagcggggagtcagtttttcgtgaaacaggagaacaccgaagaataaagctgtcactggttccagagcacccaatattgccgttggtgtagagcctatataatggatggccagtgcggtacagaccagtgatacggcagttggcaggatggcgagtgatagtacatcggcccagagccaggcagacggtattacttgcagttccgtacagaaatttaaacggacgatataaaccgatagtccgaacaaaatggcatagaaggtaagtttcgtggtcggcaggtttttcaatgtcgaacggtttacacctactatatatatagcataagagagagaagacaacagaacaaagataattcccaaagtcgatagcggtttgttgccgtctccctgataaagcaaggcaatgcctgaaagtgccagcaggatggagaaaacggtaatggcggaaatcttttccttgaagaatattcccataatgacagctaccatcaccggataaacaaacagaatcgttgaagcaattccggcatccatataattatagctcataaacaaaagcagtgatgaaaaagagaataacagccccataatgactaagggcaaaacgtctgccttatgaagtgcaaaagactgatgctgcattttcattagaatacccaatacgattgtcgcaaagaagtaccggtagaataaaacggtatcgacactcattccggctgcatagagcggaagtgcaaaaagaggattcataccgtagctcgcagcggcaatcgctccatagataaaacctttggttttgttagtcattgttttgctttttttaatggcgtgcaaaagtacgcagttcaccaatgataaacaagtgtttaggcggttgatagtataatttaatctttcgtatgcaaaaaactatttcttggtaaagagataactaatcttgtttatgcataaaattaatcgtctgactatagtcaaacttgcgtctgactactgttaaacttacgtctaactatagttgaactttcgtctgactatagtcagacgaaaaagaattaaccgttagatgattaattttattcggtagggagattagttatacgcctcccgagtaatagtctgcaggcaataggcaatcaggtttttgaataaacgcttgcatatatcttggattttcccgaatattgcatctgaattatcgaaaaacacagatggccaaagctaaatttcttgttgtttattgcctgttcatatcgggactttgttgcatggcaaatgtgacgaaggatatcaatatgcgctttaaggacgtaaggcagggactttctcatcaaacggtcaattgtttctatcaggatgaattcggatttttgtggatcgggactcaagacgggctgaatcgatttgacggacgtaagtttgaagtattcaaaccggataacgctaatccttattccatcaatatcaataatatcaggcaggtttgcggaaataaagccggattgctctttatccgcagtttgcagagcgtgactctttatgatatgcgtttgaatcgttttagggtgttgcgtgaaggagaagttgcgggaatctgttatgcgcacgatgcattatggatagctaccggaaaggaaatctaccgttatcgcaacctcgaccaggcgcccgagttattcttttcatttccttcagatgaggaggatgtattgatgaacagtctcatggttcgtcagaatcagacagtggtggtgggtacttcttcgaaaggtgtatactgcatcgaccagtctgcacatatcacccggcgtatggatgtgggagctgtcaattcaataacggaagacagaaacgggagtatctggatagctaccagaaacagagggctcatacggttggatgaagatggaaaatttactcatttcaagcataataaggtagctgaaaatacgattaaccataataatgtgcgtcatgtgacgcaagctaatgatagtctcctgtatatcggaacctatgccggtttgcagactttaaacctgtttaccggagagtttacagattatgaatatgacttgaatgtggaggcggccgatatacgttctattatttcgatgcattacgacgcttcggggactttatggttggggactttctatcagggaatccaatattataatgtagcgaatgatgctttccatttttaccgctcgtctacggctgttggcggtcatttgaattcttatattatcagttccattgccgaagaccgttccggccggatctggtttgcaagtgaaggaagtgggttgaactattatgataaacataccaaacgctttttccctttaaaaaaggtctattctcaagagctttcttttaagatagtgaagtctctttattatgagagagagccggattatctttgggtagcttctctttatcagggaatcaaccggattaatctgtcgaccggacatatagaatctatcccggaaaacatctatactccggaaggaaaaacagttgttgacagagcttataatctggtgaaaatgatagagtttgccggccacgattctttattgatagctgccaagggaggattgcttgtattggataagaaacaccttcgacttcatcatttcgaacacccttcgttggctgccaaacatctgtcgcaggtttgggatatgacgtttgacaaagacggggatttatggctgactacctcttttgatctgatacgagtcaacctcaaagcgggcactgcccatagttatcctttctcccaaatagcgcagagcacagcgcagcatcacatcaaccacattttatgtgataagaaaggacgtatatggctgggatcgacaggctcgggaatttatctatttgataagaagacagattcttttgtgggatacggagcgaaacagggattggaaaatggatttataaccggattggtggagagtcctttggatggttctatctatgtggcaaccaatggtggtttctctaaattcaatctggcaacgactacattcgagaactataacagacagagtgattttcccttgaataatgtaaatgacggagggttgtatattgcgtccgaccacgatatttacgtgtgtggtctggcgggtattgtctctatcgcccaggaaaagctgaacaaacagtctgttgactatgatgtgtttgtaaaacgggtgcttgtggataatacggaaatacaaccacttgattcgttggggcttatcaaagaaaccgtactgtatgaacatcggttagtattgccgcccagatattcttccgtcacttttgagatagcaagtaacaccctgaataatatttctaatatcggcctggaatataaacttgaaggctttgacaacgaatatatgaaggcgggcgataatacgatgattacctataccaatcttcatccggggcattatactttccatgtccgtggcgaccaggtgggcgttcacggtcaggaagcaccttccgttagttttgagctgatagtggaggctccggtttatcagcgggcatggtttattttgctgatggtgctggcagctatcctcattgccggctatattatccgtatgttctggatacgaaaaaccttgcggcactctttattggccgagaaacgggaaaaagagtatatcgaaagtgtgaaccagtccaaactgcgtttctttaccaatgtatcgcatgaattccgtaccccgttaacacttatatccagccagctcgaaatgctcctgatgcataaggacattattcctgaagtatataataagattctggatatttataaaaattcccgtcggatgaataacctcgtggatgaagtcattgatatccgcaagcaggatcagggatacttgaaactaaagatttctaaagagaatattgtggcggtgatagaggaaatttgtggttctttctatagttatgcccaactgaataagatagatctccgcttttcttccactctgaaagaagctgatttgtatattgataaaacacagatagagaaagtattctataatttattgtccaacgcttttaagtatacgaagcctggtgactggatttctgttgagctgtcagcggaaggagataatgacattgtgatttcagtcaacaacctgggggtaggcattgataaatccaagatcaaacatgtatttgaacggttttggcaggatgattcggcaacaaccacacgaactgtcaaagggtcgggcattggattggcgatggcgaaaggaattgtagagttgcatcagggaaccatcggagtggaaagcgaaccgaatagagttacctcttttaccgttactctccaccgggatgcgaatatgaatatggaagtctcttcctccgcagacgagcacgttgccgaacattatataatagagcctcaagaaatctcggaaatggtgaagccggataaaacggtgaaaatactgattgtagaagataacccggaaatgcgtaaagtattgacgcagatttttgaacagatatatgaggtatatacggctgccgacgggcaggaaggattggaacgggcttcttcgctccaaccgcagatgattgtaagtgacatcatgatgcctgtcatgtccggactggaaatgtgcgagaagttgaaaagtaatttgcagaccagccatatacctgttgtcttgctgacagcccgcaaccgggaagaacatactttggaaggcttgcagacaggtgcggatgattatatctccaaaccttttaatatcaagatattggtagcccggtgcaacaatatcatccagactcgtaaactacttcaacaacggtttgttcgaaacgacgaacctaaagtggaagaccttccgtttaatccgatcgataaaaagatgttgatggatgctacggcgattgtggaatcttatattgataacccagactttgacgtagctacttttgcacgagaaatgtgtatgagcagaacgttgcttttcaccaaattgaaagcattgaccggacagaccccgaatgactttattttatctttgagactgaaaaaagcaacagaaaaattgcggaatgaccccaatgccctgattgctgatatagcatttgattacggtttttctaatccaagttattttatccggtgttttaaaaatgcttatgatattactccggctgcttatagacggaaatatgcaaactcttaatttatagtgttttatatactttctgcctgacgagatttgtactatttgaacttttatacggacgattctattattcgaaatcattaataattgggatttttgcgctgtaatcattcaaattattacatagtatgaaaaacatcgtaattaaatgggctgtgttcctgacagcctttcttatctctttagaggttagtgctcaaaacgtcagagtttctggagtggtgacagacgcacttggaccgatccccggagttaatatcatggaggaggggactactaatggtacagtgacggatgtaaatggaaaatattcaatcagtgtatcggctaaatctacccttgttttttcttgtataggatataaggaacaaaaaatacgtgtcggtacgaaaacggtgctgaatgtgaatatggtggaagagtcgaaaatgctcgatgaattggtggttgtcggttatggagttcagcgtaagagtgatgtggccacttcggtagcttcggtcaaagcggatgaaatgagaacatttcccgccggaaatgtggctgacatgttacgtggacgtgccgcaggtgtgaatgtaacgagtagttccggacggccgggatcgactccttcgattaccattcgtggttcccgttctatcagtgcggacaatgcacctttatatattatagatggttctccttccagtgcaacagagttcagtacgttgagtgcggatgatattgaatcggttgaaatcctgaaagatgctgcgtcacaggctatttatggtgcacgcgccagtgacggtgtggtactggtgactaccaaacgtggtaaagccggaaaagtggaagtcaactataatggttatctgggtattcaatctctctggagaaatttcgatttctactctcccgaagaatatatgcagcttcgtcgtgaagcaaaggcgcatgataaaggaataattgatgcgcgtgagatttctatagccgaagcgttggaagacgaggtgatgcagcgggtatgggccagtggaaagtttatcgactgggaaaaagaaatgttcagaaatgcaatctatcataatcacgacgtcagtgtacgtggaggaacagaaaaaatcaaagtatcggcaggtgccaattactttgaccaacaaggaatggtggttaccggatcggggtatcagaagttttctttaagactgaatctggactttgaaatagccaaatggattagtttcggtatcaattcttcttatgcgatgacaaaacaagatcgtgaggatggtaactttaatgattttattaccagttctccattggcggagatatatgatgcggatggcaagtatacaaaatatatcaactcggaaggaaattataatcctttgtaccgtgccgaacattatggacgtgaagtaacccgtgataattaccgcctgaacttttttatggatgtgaaacctttcaagggattcaattatcgtctgaatacttctgtttataatcagacgtctgaagacggttcttataaagattcccaatatccgggaggcggaggaacggccgttcttgacgaatcgcgtacacagaactggctggttgagaacattgtgacctataaagtgcctatccggaacaagaaacaccagttgacattgaccggcgttcagtctgtcgaccataatgggtcgaagtctatcgggtactcggttgagaatcttccggtggataaagactggaacttcatttctcaaggtgagtttacaggcaagcctcgtcgtcagtttaatgaaaataacctggtgtctttcatggctcgggcgcaatattcgcttttagatcgttatttgttgaacgtggctgtccgccgtgacggttccagccgtttcggaaaagaaaataaatggggaactttcccgtcggcagcttttgcctggcgtgtcaatcaggagagtttcctaagagatgtgtcgtggattgataacctgaaactgcgtgtaagttatggtattgtaggtaatcagaacggtatcggcaattatactactttgggactggctgataataaaggatatgagtttggaaatgtttttcaaatgggatatttgccgagcaaggaactgtctaatccaaacctgaaatgggaacagtctgcaacagctaactttggtgttgactttagtttcttcaatgggcgtctgaatggtacggttgagtattataatacacatacgaaggatttgttggtgaaacgttccctgaatgcgtcactcggatatactaccatgctagataatctgggaaagacgaaatccagtggtatcgatctttctttaaatggtgacgtggtacgtacaaaggagtttacctggacactcggaactaatttcagcatgtataagaatgaaattgtccgtattgacgatactctcgatgagaacgggaaaccggcaagtcaggtagcccaggggtggattatcggagaaccgatcaatgtatactatgattatctgatagatggaatttttcagtatgatgattttgatatcactcgtgatggtacgggaaatctggtctataccctgaaaaacacctatgatagtgataatgacggtgtggccgacagtccgattaattacggtggcgctattgaaccgggaatggtcaaggtgcgtgataacaacggggatggaaagattacagctgatgacagggtacctatccgtaaagatccgaagtttacactctccctttcttctacatggaactggaaaggatttgacctgttcatggactggtatggagtttccggcagaaagattaagaacggttatttgtacgagtataattccggtggttctttacgtggaaaattgaatggggtgaaggtggattattggactccgttcaatccttcgaacaaattcccacgtccttcttatagtgcggaccctgcatatttgagtgccattgccattcaggatgcttcttatatccgtttacgcaccttacaactgggatatactttccccacccgactattgaagaatactccgattcataaattacgcttgtatgcaacagctactaacttgctgacatttacggagtttaaatcttatagtcccgaactgactccagggtcttatccggagtccagacaatatgtgtttggtgtcaatgtttcattctaaaataaagaatccttatgaaaaagttaatatatacagcctttgtcatttgcggaatgttgaccgcttcctgctcggatttattaaatctggaatcaaaaacagacgtgacgaataattatctgttcactactcccgaagggttgaatactgtcgttacaggattgtattccctggcacgtgaattgccgggtggagcggataataacgaatctaatctgtacatcgttaccatgtgtgactttaatacggatattgccatacttagagcaggtgtttctacctcaatcggacgtttgaatacaagttttactccaagtaccggagatgtcaataagttctggaaacatcactatgggattatcggaaaagcaaatgaaattattgtagcggcagaagccttgggactggatgacagcgatgtattgcacgcatggagtgaagcgaaattcttcagaggacggagctattttgaactttggaaacgctttgaccgcctttatctgaacatcactccaaccactgtagataatctgaaacgggagtataaaccggcttctcatgaagaactgatgacactgatgacaactgacttggatgatgcgatgaaaggtctggactggtcacttcctcaaaataacggaaatgtattgtatggacgggtaacgaaagcgactgccaaacatgtccgtgcacaggttgccatgtgggaatcggattgggatacagccattgaggaatgtgaagacatctttaaacaggagggcatttactcaatggaaaagaaggccgagaatgtatttaatagcgcagatttgaaatccccggaagtgttgtggagtttccaatattcacaaaacttgggtggaggaggttccggaactccggttgccggacatcgtatctctattcagaccactacccgaatcaataaaattgcaggttgtatcaatacggccgatcagggtggatatggttggggacgtatttatccgaatacctatttattgagtttgtatgaccaggctaaagatacacgatacaatgaattgttcgtacaccgtttcaaatacaatgatcctacttctcctaaatatggcgaattgattccccttgcgaaaagttccagttattgtgagacgctgcatttcatgtcgaaaaaatactttgatcagtggactatggccgataatccggaccggacaacgggattcaaggatttgattgtctatcgactggctgaaacttacttaatggcggcagaagcgtatatgcgccgtgacggaggaatgagcacggatgctctgcgctgctacaataaaacatgggaacgtgccgggaatgacaaatttgcgggacctctgacgcaagatattcttttggatgaatatgcccgtgaactgaacttcgagggagtccgttggcctttactaaaacgtttgggtcttttgggtgaaagggtgaaagcgcattatggcgagacaaaagctgaaaatccttatttagataaagattatgcggaatgtcgtaccagttttgtagttggaaagcacgaatgttggcctattccacaggagcagattgacttgatggggaaagagaattttccacagaatgagaattggtattaagcgattgattatctgtaaaacatgaatgagtatgaaaaaaataatatatctgttattgattttaaatctggggctgctttcctgtgtcgatgatgcgtcggtacgtgtgatgcctgaatttaattgtaaagatacaaaagtaaacctggcaaaagcggcgggttcttccgtcacatcgctattatatactaatgtcggtcaggttgttgctcaatatcaagcggagtggctttctgtagatgtaaacgctaaaagtgtaatatacactgccttgacgcagaatgacggtgaggatgcaaggagtactgtcgtgaaactgacttgcggttcatatacagtggaagtgacggttacacaggattccaaagaaccggacctttctttgaaggtaggacaaagtgtagatgatggtatcggtatgattttctgggtggatccttcggacaagatggtaggaaaagctgtatctgtaaaacgtcagggaggaaatccttttgaggcttctgtgatgtctcataatgcgctttctacagtgaatggatatgccaacacggctttgtttactgctcctgctgcaaatgatgcagtggcatactgtcagtcgttgggtgagggatggtatctgcctgcacgtgatgagttatgggagttgtttgatgtttacaacggtattggacatgctgatccggattttgcttcggttgtacctgataagttgacggaagttgagaaagcggcccgtgcggcatttgataagatgttgaccgatttgcagggtgatgtgataaacgaggctgccggttcgggcaatggggaaagctattggtcgagtacggaaaatgcagcaggggataaggcttattgggtacgtttcggaaagtctggtgctgatgcaggaaataaaacagctaccaaccgttttgtgagatgtatgcgcacaattggtgattatacttatcctgaagagccggcaactctgacggttgctcccaatcctgtgacattggaaggtgctaacgaagcggaagcaaatgttacgttgacatccaataagagtgtattcagcgtggtgttggcagatgattcctggctttcatatactatttcaggcacaacagttacgttcaaggcaaaatcaaaaaataccactggtaatattcgtacgacaattgctacaataacagccggtactggcgcagccgcaaaagcagtggaggtaacagtgaatcaaaatgtagctgccgagggagacgcttccctcgaattgagtaccaatacggtgactattacgcctgatgcggtagcaaaatcagaggtaatcacaatgatttctgatgagacggaatttgcaataaatatcactgatgaatcttgggtgaaagcgtatgttgatgtaacaaataaaactctttatttttggacattatctcccaatctgaatagttctaaccgggtaacgactgctacggtaacagccggaagcggagcgaatgcacctaaacaagaggttacgattacacagagaggatttttaagttccgagtttgcggtgggacaggtaattgcggataatggttcgttaaaaggaggcattgtgttctgggtagatggaactaatcgtggtaaagcgaaaatcatgtcgttggacagagagaatttggcatggtctacagcaggctctccggcttctaccggagtggatttatccggagatgatggatatactaatactatggcgttggctgcattaccaaatgcatcggaaatgcctgccattaagttctgtatggacaaggggacaggttggtattggtcggggagaaaagacttggaacaaatgtttgaaacatataatggaaccactgtagcaaatgcaacaaatgataatccgaatgcgattactgattttgaaaaagccaatcgtgcagcatgggatcgggttgtcagcaatgcgggaggaactattatgaatgaggctgcgtcatcttctacaggagatacatattgggcttgtcgtgaggcttcgaatggtgtgaatggattttatgtacgttttggaaagcctatatcttggagcagtgcaacctctaaaaagagttctttaagatatattcgtgcagttcgttcaatctcgaaataatggtattaggtatgtataaggtatatagaaaaataatcttagcctgcttgttattgattgttgccggcacggtctgcggtcagcgtgtgacgcaaacgatcaacgatggttggaagttctccctctttgagggagacgcgtccactgctgactttgatgtgtccggttggactgacgtttccattcctcatacttggaatgcaaaagatgcagaagatgaaatccccggttatttccggggaaaaggctggtacaggaaagccgtgacagtggaggaactgattgtcggtcaaagagtttatctttgttttgaaggagccaatcaggaaacaaatgtatttgtgaatggaaagttggtagggaatcataaaggtggttattctgcttttacgtttgatgtgactgactatgttcataccggacgcaatctggtagcagtgagtgttgacaactcttataatccggatattgctcctctttcggcagactttactttcttcggcggactttatcgggatgtttatctggtgtatacttcgcccgtgcaactgtctaccacccattatgcttccagtggagtatatctcaaaactgttggaataacagacgctcaagcggaagtgtgtgcaaaaacattcttgtccaatgctttgaaaagtaatcaggcattgattcttgaaacggagattttggatacagacggcaatagagtggcactttccgcaaagaaagtgaatgtgaaggcaggggagaagaatgtagcctttgaagcgttgatgactattgcgcaacccaaacggtgggatgttgattctccttatttatataaggtgtatagccgtttgaagaataaaaagggagaagttctcgattgcgttgttaatccgctgggaatccgtgaatatcattttgatgcggaaaaaggttttttcctgaacgggaaatatcggaaattgattggtaccagccggcatcaggattacaaaggaatggggaatgccttgcgggatgaaatgcatatccgggatatacagttgagtaaggatatgggaagtaatttcctgcgagtggctcattatccgcaagatccggttgtgatgcagatgtgtgataaattggggctgttgacttcggttgaaattccgattgtaaatgccattactcaaagtagggcgtttatggacaactgtgtggaacaggctacggaaatggtttatcagaaccataattatccgtctgtcatcatttgggcttacatgaatgaagtgcttttgcgtcctccctttaatcctgacaacaagaaagaacgggcggaatatatgaagtctcttcatcaaatagcttcggctgttgaggcgcagatcagaagtctgaactcggaacgctataccatgttgccttgtcattctgcttcccaaatctatcaggaagcagggattactgaattgccgatgttattgggatttaatctttataatggatggtatggtggtaatttggacggatttgaagagaaactggaagaacttcacaaggagtttcctcataaaccgttgcttattaccgaatatggggcggatgtagatactcgtattcattctttttcgcctgtgcggtttgattttagttgtgagtttggctctgtctatcatgaacattatttgcctgaaattctaaagagggattatatcgtgggggctatggtctggaatttgaatgatttttattccgaagccagaagaaatgccatgcctcatgtgaacaataaagggttggtaagtacggatagagaacgtaaggacggatattttctttatcaggcttatctgaaagagtcacctgttctgcatattgcttctaaatcttggaagaatagggcaggagccagtcgggatggaaagagttgtacgcaaccgctgaaagtttatactaacgcggataaggtggaggtctttttgaatggaaaaagtttgggagtatatccggtagcagataaggtggtttccgtggacattccttttgtaaacggaaagaatgtggtggatgctgtgattgaaaaggagggacgtgaatatcgtgaccagtatgtttgtgattttaaatgtgtcaatgtgaagaatggctttacggaaatcaatgtactactgggtgctcgacgctattttgaggaccggatagcagagatgtgctggatacccgaacaggcttatgcagaaggttcatggggatatattggtggggaagtggctccgaacaaaactcgttacggttctttgccggccagcgataaagatatactggggacggatcaggatcctatcttccagacacagcgagtaggcattgaagcttttaaggcagatgtaccggatggtgtttatgctgtatatttgtattggacagaacttacttctgaaaataaaagagaggctttggtgtataatttaggaaatgatgtggtgagggaggactatattaaccgggtattttctgtggatataaatggagtatctgttgccaaacaactgaatattgcagaagaatacggttccgaacgtgcggttattaagaaatatattgttccggtttcacaaggaaaggggcttgtcgttcgttttggagcggtggagtctgtgcccattttaaatgcaatacgaatcgtaaaagaatattagatgatgaaaaatagtatagttatattgtttttactgctgttatcccagtttggttatgcccagggacgtacatttaaggtcactgcccgtccgtgggtgaaaggacagaaaaatctgccttggaaagagtatgatacccgtactattgctcaattggatgggttcaaacctactggtaaagtacgtgtgaataagtatggaagtgatttggatgctcccaggcatcgggctacaggatttttcagggtagaacgtattggaaatcgatggtggatgattgatcccgatgggtatcggcatttgcagaaagtggtggtaggagtacgtttaggtacttccgaacgcaataaacaagcaatgctggacaaattcggtacggaggaaaaatggatcgaaggaacggcacggatgattcattcgctgggcttttccgggaccggctcctggagtaatgaagaagctattgcctcttacaatgcctctcataaggaggtactgactcgctcaatcattctgaacctgatgagtggatatgggaagaaacgaggaggaacttatcagttacctggtaatacgggatatcctaatcagtgtattttcgtttttgacccggagttcgaaacctattgcgatgagatggcacaaaaactggtcgcaaataaaacggataaaaatatcatcggctatttttcggataatgaactgccgttcgggccgaagaatctggaggggtatctgactttgaagaatcccaatgatccgggaagattgtatgcagaatcctggttgaaacagcagggtattactttgcagcaaattacggacgaacatcgggaagagtttgcgggggtagtagcggaacgatactataaagtggtgtcggaagcgattcggaagtatgatcccaatcacctttatttaggtagtcgtctacatggaaaacctaagtttatccgccagattgtggaagcggcaggcaggtattgtgatgtcgttgctattaactactatggtgcatggacaccgagtgagaagaccatgaagcattggggcgaatgggctcaaaaacctttcatcatcacggaattttatacgaaaggaatggattcagggctggcaaacacaacaggggcaggtttcaccgttcaaacccagcaggaacgtggatatgcctaccagcattttgttttgggattattggaaagtgggaattgtgtcggatggcattggttccgttatcaggataatgatccgacagcaaaaggggcagatccttcgaatctggactctaacaaagggctggtagataatgaatacaatctttataaaccgttggctgatgctatgaaagaattgaatatcaacgcttatcgtttggctgactggttcgaccaacaatcaactaataataaataaaatacatacc
